(12) United States Patent
Nakagawara et al.

(10) Patent No.: US 7,429,451 B2
(45) Date of Patent: Sep. 30, 2008

(54) NUCLEIC ACIDS ISOLATED FROM STAGE 4 NEUROBLASTOMA

(75) Inventors: Akira Nakagawara, Chiba (JP); Miki Ohira, Chiba (JP)

(73) Assignees: Hisamitsu Pharmaceutical Co., Inc., Tosu-shi (JP); Chiba-Prefecture, Chiba-shi (JP)

( * ) Notice: Subject to any disclaimer, the term of this patent is extended or adjusted under 35 U.S.C. 154(b) by 353 days.

(21) Appl. No.: 10/533,158

(22) PCT Filed: Oct. 30, 2003

(86) PCT No.: PCT/JP03/13932

§ 371 (c)(1),
(2), (4) Date: Aug. 30, 2005

(87) PCT Pub. No.: WO2004/039975

PCT Pub. Date: May 13, 2004

(65) Prior Publication Data

US 2007/0281296 A1 Dec. 6, 2007

(30) Foreign Application Priority Data

Oct. 30, 2002 (JP) ............................. 2002-316586

(51) Int. Cl.
*C12Q 1/68* (2006.01)
*C07H 21/02* (2006.01)

(52) U.S. Cl. .......................................... 435/6; 536/23.1

(58) Field of Classification Search ....................... None
See application file for complete search history.

(56) References Cited

U.S. PATENT DOCUMENTS

2003/0207286 A1 11/2003 Nakagawara et al.
2004/0181048 A1* 9/2004 Wang ........................ 536/24.3

FOREIGN PATENT DOCUMENTS

WO  WO 01/66719 A1  9/2001
WO  WO 01/66733 A1  9/2001

OTHER PUBLICATIONS

Tockman et al (Cancer Res., 1992, 52:2711s-2718s).*
Rehman et al (Nucleic Acids Research, Jan. 1999, 27(2):649-655).*
Kawamoto et al., Association Between Favorable Neuroblastoma and High Expression of the Novel Metalloproteinase Gene, *nbla3145/XCE*, Cloned by Differential Screening of the Full-Length-Enriched Oligo-Capping Neuroblastoma cDNA Libraries, Medicinal and Pediatric Oncology, 35:628-631 (2000).

Islam et al., High Expression of *Survivin*, mapped to 17q25, is significantly associated with poor prognostic factors and promotes cell survival in human neuroblastoma, Oncogene, 19:617-623 (Feb. 3, 2000).
Aoyama et al., High Expression of Human RIM Gene in neuroblastomas with favorable biologies, 31st Annual Meeting of the Society for Neuroscience in San Diego, CA Nov. 10-15, 2001, Society for Neuroscience Abstracts, 27:715 (2001).
Tang et al., Implications fo EPHB6, EFB2, and EFNB3 expressions in human neuroblastoma, Proceedings of the National Academy of Sciences of the United States of America, 97:10936-10941 (Sep. 26, 2000).
*Homo sapiens* BAC Clone RP11-650J17 from 4, complete sequence, Database EMBL [OnLine], EBI Accession No. EM_PRO:AC093879 (Sep. 11, 2001).
Akira Nakagawara, "The gene which controls biology of neuroblastoma", Japanese Journal of Pediatric Medicine, vol. 30, No. 2, 1998-2, pp. 143-148.
"Sounding board, regression of neuroblastoma IV-S: a genetic hypothesis", The New England Journal of Medicine, May 29, 1980.
Akira Nakagawara, "Topical topic, the NGF story and neuroblastoma", Medical and Pediatric Oncology, 31:113-115 (1998), 1998 Wiley-Liss, Inc.
"Expression and prognosis of TRK family receptor in neuroblastoma", Shoni Geka (Pediatric Surgery), vol. 29, No. 3, 1997, pp. 425-432.
"Genetic events in neuroblastoma", Molecular Medicine, vol. 36, No. 4, 1999, pp. 366-372.
Eggert, A. et al., "High-level expression of angiogenic factors is associated with advanced tumor stage in human neuroblastomas", Clinical Cancer Research, vol. 6, 1900-1908, May 2000.
Gallego, S. et al., "Differential polymerase chain reaction with serial dilutions for quantification of MYCN gene amplification in neuroblastoma", Anticancer Research, vol. 18, pp. 1211-1216 (1998).
S. Yamane, "Gene Expression of tumor rejection antigens recognized by cytolytic T lymphocytes in neuroblastoma-related tumors", Journal of Kyoto Prefectual University of Medicine, vol. 108, No. 3, pp. 381-388 (1999).
The Sanger Centre, et al., "Toward a complete human genome sequence", Genome Research, vol. 8, pp. 1097-1108 (1998).

* cited by examiner

*Primary Examiner*—Misook Yu
*Assistant Examiner*—Sean Aeder
(74) *Attorney, Agent, or Firm*—Fitch, Even, Tabin & Flannery

(57) ABSTRACT

Diagnostic agent or kit for the prognosis of neuroblastoma is used to diagnose the prognosis of neuroblastoma (particularly, classifying its progress and determining stage 4s neuroblastoma), which agent or kit comprising a nucleic acid probe, nucleic acid primers, or a nucleic acid microarray utilizing a nucleic acid comprising one sequence selected from the group consisting of nucleic acids set forth in SEQ ID NO:1 to SEQ ID NO:174, a fragment thereof, or a combination of either or both.

9 Claims, No Drawings

NUCLEIC ACIDS ISOLATED FROM STAGE 4 NEUROBLASTOMA

This Application is the U.S. National Phase of International Application No. PCT/JP03/13932 filed Oct. 30, 2003, and claims foreign priority from Japanese Application No. 2002-316586, filed Oct. 30, 2002, the complete disclosures of which, including any and all sequence listings, are incorporated herein by reference.

TECHNICAL FIELD

Sequence Listing

The instant application contains a "lengthy" Sequence Listing which has been submitted via CD-R in lieu of a printed paper copy, and is hereby incorporated by reference in its entirety. Said CD-R, recorded on Apr. 26, 2007, are labeled CRF, "Copy 1" and "Copy 2", respectively, and each contains only one identical 672 KB file (73884325.APP).

This invention relates to nucleic acids derived from genes expressed in human neuroblastoma. More particularly, the invention relates to nucleic acids derived from genes expressed in human stage 4s neuroblastoma. Further, this invention relates to diagnostic agents and diagnostic kits for stage 4s neuroblastoma comprising nucleic acid probes, nucleic acid primers or nucleic acid microarrays utilizing those nucleic acids, their fragments, or the combinations of the foregoing, as well as to the elucidation of the mechanism of the programmed cell death of cancer cells based on the nucleic acid sequence data from the abovementioned genes.

BACKGROUND ART (Tumorgenesis and Genes)

Individual tumors exhibit distinct characteristic natures, and their biological properties are not necessarily identical even though the basic principle of oncogenesis is the same. Rapid advances in the understanding of cancer from a molecular biological and molecular genetic perspective in recent years have opened the way to an explanation of oncogenesis and the so-called tumor cell biology on the genetic level.

(Neuroblastoma)

Neuroblastoma is a pediatric cancer occurring in sympathetic gangliocytes and adrenal medullary cells which originate from cells of the peripheral sympathetic nervous system. Of these sympathetic neurons, neural crest cells in the initial stage of development migrate to the abdomen, differentiating and maturing at sites where sympathetic ganglia are formed. Some of these cells migrate further to the adrenal bodies, penetrating through the adrenal cortex which is already in the process of formation, and reaching the medulla and forming medullary substance there. The neural crest cells also serve as a source of other peripheral nerve cells, differentiating into dorsal root ganglia (sensory nerves), skin pigment cells, thyroid C cells, some pulmonary cells, intestinal gangliocytes, and the like.

(Prognosis for Neuroblastoma)

Neuroblastoma is characterized by a varied clinical profile (Nakagawara, Shinkeigashu no Hassei to Sono Bunshi Kiko [Neuroblastoma Development and Molecular Mechanism], Shoni Naika [Japanese Journal of Pediatric Medicine], Vol. 30, p. 143, 1998). For example, neuroblastoma occurring at less than one year of age has very favorable prognosis, with the majority undergoing differentiation and cell death, and results in spontaneous regression (which may be referred to as "favorable prognosis type"). Currently, most neuroblastomas discovered by a positive result in the commonly performed mass screening of 6-month-old infant urine are of the type which tend to undergo this spontaneous regression. On the other hand, neuroblastoma occurring at age 1 or higher is highly malignant and leads to death of the infant in the majority of cases despite therapy (which may be referred to as "unfavorable prognosis type"). It is also hypothesized that a somatic mutation occurs in highly malignant neuroblastomas in infants older than one year of age, which are of monoclonal nature, whereas in naturally regressing neuroblastomas, the genetic mutation remains at only a germ line mutation. See Knudson A G, et al.: Regression of neuroblastoma IV-S: A genetic hypothesis, N. Engl. J. Med., Vol. 302, p. 1254, 1980. In addition, there are known neuroblastomas of the intermediate type that are clinically positioned between those two types.

When the neuroblastomas are classified according to the progress of tumorization, they are as follows:

Stage 1: the tumor occurs primarily in adrenal gland or sympathetic ganglia and is confined.

Stage 2: the tumor is characterized by being confined to the site of origin and regional metastasis only to lymph nodes, which does not extends beyond the median line.

Stage 3: the tumor extends beyond the median line to invade into the opposite side or to metastasize into lymph nodes.

Stage 4: the tumor causes distant metastasis to bone, bone marrow or the orbital region.

Stage 4s: the tumor occurs at less than one year of age and causes distant metastasis to bone marrow, skin or liver.

The neuroblastomas of the favorable prognosis type are tumors at stages 1, 2, and 4s, while the neuroblastomas of the unfavorable and intermediate types are tumors at stages 3 and 4. The tumor at stage 4s is peculiar and normally occurs in an infant at several months after birth. Although the tumor grows and metastasizes quickly, it suddenly stops growing and then disappears spontaneously. Thus, the tumors that regress spontaneously and the tumors that grow malignantly are clearly distinct, with respect to the age of onset, the site of metastasis, and the progress.

(Genes which Allow the Prediction of Prognosis for Neuroblastoma)

With recent advances in molecular biology research, it has become clear that expression of the high affinity nerve growth factor (NGF) receptor TrkA is closely connected with control of differentiation and cell death (see Nakagawara A., The NGF story and neuroblastoma, Med. Pediatr. Oncol., vol. 31, p. 113, 1998). Trk is a membrane-spanning receptor, existing as the three major types, Trk-A, -B and -C.

These Trk family receptors play an important role in specific nerve cell differentiation and survival in the central nervous and peripheral nervous systems (see Nakagawara, et al., Shinkeigasaiboushu ni Okeru Neurotrophin Juyoutai no Hatsugen to Yogo [Expression of Neurotrophin Receptors and Prognosis in Neuroblastoma], Shoni Geka (Japanese Journal of Pediatric Surgery), Vol. 29, pp. 425-432, 1997). The survival and differentiation of tumor cells is controlled by signals from Trk tyrosine kinase and Ret tyrosine kinase. In particular, the role of TrkA receptor is most significant, with TrkA expression being notably high in neuroblastomas of the favorable prognosis type, and its signals exerting a powerful control over the survival and differentiation of tumor cells, and cell death (apoptosis). In neuroblastomas of the unfavorable prognosis type, on the other hand, TrkA expression is significantly suppressed, while tumor development is aided by a mechanism in which survival is promoted by signals from TrkB and Ret, instead.

It has become clear that amplification of the neural oncogene N-myc is associated with the prognosis of neuroblastoma (see Nakagawara, Nou-shinkeishuyo no Tadankai Hatsugan [Multistage Oncogenesis of Cerebral and Neural Tumors], Molecular Medicine, Vol. 364, p. 366, 1999). This gene, first cloned in neuroblastoma, is ordinarily only present in a single copy per haploid set in normal cells and neuroblastomas of the favorable prognosis type, whereas it has been found to be amplified several dozen times in neuroblastomas of the unfavorable prognosis type.

In addition to the genes described above, CD44, PTN, caspase and others are known as the gene whose expression is high in neuroblastomas of the favorable prognosis type, whereas SVV (survivin), MK (midkine) and others are known as the gene whose expression is high in neuroblastomas of the unfavorable prognosis type.

Furthermore, the present inventors found that a group of novel genes was highly expressed in neuroblastomas of the favorable prognosis type (International Publication PCT/JP01631 pamphlet). By contrast, the present inventors found that a different group of novel genes was highly expressed in neuroblastomas of the unfavorable prognosis type (International Publication PCT/JP01629 pamphlet).

Up till the present time, however, there has hardly been any information concerning the genes which are expressed in stage 4s neuroblastoma, particularly with specificity. Further, since stage 4s neuroblastoma regresses spontaneously, there is an urgent need to identify the causative genes.

DISCLOSURE OF THE INVENTION

This invention has been accomplished in light of the problems inherent in the above-described prior art, and its object is to identify the nucleic acid sequences of genes which are generally related to the favorable or unfavorable prognosis of neuroblastoma, and to allow for providing such genetic information and for diagnosis for the prognosis of neuroblastoma (whether favorable or unfavorable). This invention specifically aims at diagnosing the prognosis of neuroblastoma, classifying the progress of the neuroblastoma, and enabling the determination of stage 4s neuroblastoma.

As a result of conducting diligent research, the present inventors have examined the prognoses of neuroblastomas and have succeeded in constructing cDNA libraries from the respective clinical tissues of the favorable and unfavorable prognosis types. Approximately 2,400 clones were respectively cloned from these two types of cDNA libraries and were classified according to the prognoses of neuroblastomas (whether favorable or unfavorable). Profiling of the genes in the respective subsets was then carried out.

Thus, the present inventors found that a group of genes showed differential expression levels among the above-mentioned subsets and showed enhanced expression levels only in the clinical tissues of the favorable prognosis type. Moreover, the present inventors found that a group of genes showed enhanced expression levels only in the clinical tissues of the unfavorable prognosis type. Based on such finding, the present inventors made it possible to provide nucleic acid sequence data which would allow the detection and cloning of genes whose expression levels are at least enhanced either only in the clinical tissues of the favorable prognosis type or only in the clinical tissues of the unfavorable prognosis type.

Furthermore, the present inventors have succeeded in constructing cDNA libraries similarly from the clinical tissues of stage 4s neuroblastoma. Approximately 2,700 clones were cloned from this library. The subset of this library and the subsets of the libraries from the clinical tissues of the favorable and unfavorable prognosis types were analyzed and the profiling of approximately 16,000 genes that were expressed among these subsets was carried out. Consequently, 452 genes were identified that showed differential expression levels among the abovementioned subsets. When these genes were sequenced, they were found to comprise 308 novel genes and 144 known genes as the reminder. The genes were classified according to their expression patterns among the respective subsets, and grouped into seven groups.

Based on such finding, the present inventors made it possible to provide genetic information (such as nucleic acid sequence data) which would allow the detection and cloning of genes exhibiting expression patterns characteristic of stage 4s neuroblastoma. Further based on the nucleic acid sequence data, the present inventors made it possible to provide diagnostic agents and diagnostic kits which allow for methods of diagnosis for the prognosis of neuroblastoma (particularly, the classification of the progress), including determination on stage 4s neuroblastoma, upon which this invention has been completed.

Specifically, this invention provides a nucleic acid comprising one sequence selected from the group consisting of nucleic acid sequences set forth in SEQ ID NO:1 to SEQ ID NO:174 in the Sequence Listing.

The preferable nucleic acid is one that comprises a nucleic acid sequence of any one of nucleic acid sequences set forth in SEQ ID NO:1 to SEQ ID NO:14 among the nucleic acid sequences set forth in SEQ ID NO:1 to SEQ ID NO:174 in the Sequence Listing.

This invention also provides nucleic acids complementary to those nucleic acids described above.

This invention further provides nucleic acids capable of hybridizing to the nucleic acids described above or their complementary nucleic acids under stringent conditions.

This invention also provides a nucleic acid probe comprising nucleic acid (a) or nucleic acid (b) described below:

(a) a nucleic acid comprising a partial length or the full length of one sequence selected from the group consisting of nucleic acid sequences set forth in SEQ ID NO:1 to SEQ ID NO:174 in the Sequence Listing, or a nucleic acid complementary thereto;

(b) a nucleic acid capable of hybridizing under stringent conditions to a nucleic acid comprising a partial length or the full length of one sequence selected from the group consisting of nucleic acid sequences set forth in SEQ ID NO:1 to SEQ ID NO:174 in the Sequence Listing, or a nucleic acid complementary thereto.

Preferably, the nucleic acid (a) or the nucleic acid (b) is DNA.

Also preferably, the nucleic acid (a) or the nucleic acid (b) is a nucleic acid comprising one sequence selected from the group consisting of nucleic acid sequences set forth in SEQ ID NO:1 to SEQ ID NO:14 in the Sequence Listing.

This invention also provides a diagnostic agent for stage 4s neuroblastoma comprising the nucleic acid probe described above as the active ingredient.

This invention further provides a primer containing DNA (a) or DNA (b) as described below:

(a) a DNA comprising one sequence selected from the group consisting of nucleic acid sequences set forth in SEQ ID NO:175 to SEQ ID NO:1076 in the Sequence Listing, or a DNA complementary thereto;

(b) a DNA capable of hybridizing under stringent conditions to the DNA comprising one sequence selected from the group consisting of nucleic acid sequences set forth in SEQ ID NO:175 to SEQ ID NO:1076 in the Sequence Listing, or a DNA complementary thereto.

Preferably, the DNA (a) or the DNA (b) is a DNA comprising one sequence selected from the group consisting of nucleic acid sequences set forth in SEQ ID NO:175 to SEQ ID NO:202 and SEQ ID NO:519 to SEQ ID NO:540, or a DNA comprising one sequence selected from the group consisting of nucleic acid sequences set forth in SEQ ID NO:785 to SEQ ID NO:798 in the Sequence Listing.

This invention also provides a diagnostic kit for stage 4s neuroblastoma comprising one pair of the primers described above as the active component.

This invention further provides a method for determining stage 4s neuroblastoma, the method comprising detecting the presence or absence of a nucleic acid comprising one sequence selected from the group consisting of nucleic acid sequences set forth in SEQ ID NO:1 to SEQ ID NO:14 in the Sequence Listing from a clinical tissue sample of neuroblastoma.

Additionally, this invention provides a nucleic acid microarray comprising a solid phase support and a combination of plural nucleic acids each comprising a partial length- or the full length-nucleic acid comprising a nucleic acid sequence set forth in one of SEQ ID NO:1 to SEQ ID NO:174 in the Sequence Listing immobilized on the solid phase support.

This invention also provides a nucleic acid microarray comprising a solid phase support and a combination of plural nucleic acids each comprising a nucleic acid sequence set forth in one of SEQ ID NO:175 to SEQ ID NO:200, a nucleic acid sequence set forth in one of SEQ ID NO:519 to SEQ ID NO:540, or a nucleic acid sequence set forth in one of SEQ ID NO:785 to SEQ ID NO:798 immobilized on the solid phase support. Here, there may be used an arbitrary combination of plural nucleic acids comprising nucleic acid sequences having the denoted SEQ ID numbers.

BEST MODE FOR CARRYING OUT THE INVENTION

The nucleic acids (which will be referred to as "the nucleic acid(s) of this invention") derived from the gene which is expressed in neuroblastoma according to this invention (which will be referred to as "the gene(s) of this invention") including their utility, will be described in detail by referring to the preferred embodiments of the invention.

As stated above, the nucleic acids of this invention are derived from the gene of the invention and they make up the gene or are obtained from the gene by an in vivo or in vitro process. There are no limitations on the chain lengths of the nucleic acids, and herein, they will be referred to as "the nucleic acid(s) of the invention," which include nucleic acid fragments corresponding to portions of the gene. When the nucleic acid chain length is short, it can be synthesized by chemical techniques.

The term "nucleic acid(s)" as used in this specification refers to, for example, DNA or RNA, or polynucleotides derived therefrom which are active as DNA or RNA, and preferably refers to DNA or RNA. The particularly preferred nucleic acid has a DNA sequence that is identical with the human cDNA sequence disclosed in this specification or that is complementary to the sequence.

The term "hybridize under stringent conditions" as used in this specification means that two nucleic acid (or fragments thereof) hybridize to each other under the hybridization conditions as described in Sambrook, J. et al. in "Expression of cloned genes in *E. coli*", Molecular Cloning: A Laboratory Manual (1989), Cold Spring Harbor Laboratory Press, New York, USA, pp. 9.47-9.62 and pp. 11.45-11.61.

More specifically, the "stringent conditions" refers to hybridization at approximately 45° C. with 6.0×SSC, followed by washing at 50° C. with 2.0×SSC. The stringency may be selected by choosing a salt concentration in the washing step from approximately 2.0×SSC, 50° C. as low stringency to approximately 0.2×SSC, 50° C. as high stringency. Also, the temperature in the washing step may be increased from room temperature, or approximately 22° C. as low stringency conditions, to approximately 65° C. as high stringency conditions.

The term "nucleic acid(s)" as used in this specification refers to an isolated nucleic acid(s) and to a nucleic acid or a polynucleotide containing substantially no cellular substances or culture medium, if prepared by recombinant DNA techniques, or containing substantially no precursor chemical substances or other chemical substances, if prepared by chemical synthesis.

The term "favorable prognosis type" as used in this specification refers to a condition of human neuroblastoma in which the tumor exists with confinement or has become a regressing or benign sympathetic ganglion neoplasm, and is judged to have low malignancy based on N-myc or other tumor markers (TrkA, chromosomal aberration or the like) by the practicing physician. According to a preferred embodiment of the invention, neuroblastoma of the favorable prognosis type is considered a case of stage 1 or 2, with an onset age of less than one year and survival without recurrence for 5 or more years after surgery, and with no noted amplification of N-myc in the clinical tissue; however, it is not limited to such a specific case. The term "unfavorable prognosis type" as used in this specification refers to conditions of human neuroblastoma in which progression of the tumor has been observed, and it is judged to have high malignancy based on N-myc or other tumor markers by the practicing physician. According to a preferred embodiment of the invention, neuroblastoma of the unfavorable prognosis type is considered a case of stage 4, with an onset age of greater than one year, death within 3 years after surgery and noted amplification of N-myc in the clinical tissue; however, it is not limited to such a specific case.

Although stage 4s neuroblastoma is classified as the favorable prognosis type in accordance with the clinical molecular biology classification as described above, it will be treated differently from "the favorable prognosis type" for the sake of convenience in this specification.

Neuroblastoma is a tumor consisting of actual neurons, of which only two types are known in humans, and analysis of the genes expressed therein is expected to provide very useful knowledge for understanding the biology of neurons. Specifically, it is extremely difficult, and practically impossible, to obtain a site-specific homogeneous tissue from the brain or peripheral nerves. On the other hand, neuroblastoma consists of an almost homogeneous population of neurons (though tumorized) derived from peripheral sympathetic neurons, and thus offers a high possibility of obtaining homogeneous expression of neuro-related genes. Furthermore, since neuroblastoma is a type of cancer, it is characteristically pointed out that there are many important genes expressed in the immature stage of neurogenesis.

Clinically and biologically, neuroblastoma can be further distinctly classified into the favorable prognosis type and the unfavorable prognosis types. Cancer cells from neuroblastoma of the favorable prognosis type are characterized by having a very slow rate of proliferation, with spontaneous regression beginning at some point. Findings to date have confirmed that neuronal differentiation and apoptosis (neuronal cell death) occur in the spontaneous regression, and that the differentiation which occurs in the maturation stages of normal neurons and programmed cell death are phenomena very closely resembling each other. Consequently, it is highly probable that the analysis of genes expressed in such tumors will lead to obtaining important genetic information relating to neuronal differentiation and apoptosis.

The nucleic acids of this invention originating in the gene of the invention from which the useful genetic information described above can be obtained have been found in clinical tissues of stage 4s neuroblastomas (which may be referred to as "4s" hereafter). When the expression levels of these genes are compared between a clinical tissue of the favorable prognosis type (which may be abbreviated as "F(favorable)" hereafter) and a clinical tissue of the unfavorable prognosis type (which may be abbreviated as "U(unfavorable)" hereafter), the genes have the characteristics described below.

Specifically, 452 genes which were obtained in the manner described above and of which were sequenced at least partially have been classified according to their expression patterns between the respective subsets to form seven groups, which will be described in the following.

Group I

The genes belonging to this group have expression levels (4s) that are on the same order as those of UF, but are lower than those of F. These genes are further classified into subgroups, resulting in I-1, I-2 and I-3. Table 1 should be consulted on the gene expression pattern of each subgroup.

The specific clones belonging to I-1 are nbla20026 (SEQ ID NO:171), nbla20421 (SEQ ID NO:172), nbla22298 (SEQ ID NO:173), nbla22549 (SEQ ID NO:174), and nbla23020, all of which are novel genes.

The specific clones belonging to I-2 are as follows: nbla21103, nbla20146 (SEQ ID NO:137), nbla20170 (SEQ ID NO:138), nbla20216 (SEQ ID NO:139), nbla20253, nbla20549, nbla20657 (SEQ ID NO:140), nbla20688 (SEQ ID NO:141), nbla20755 (SEQ ID NO:142), nbla20835, nbla20968, nbla21013 (SEQ ID NO:143), nbla21087, nbla21172 (SEQ ID NO:144), nbla21189, nbla21200 (SEQ ID NO:145), nbla21214, nbla21255 (SEQ ID NO:146), nbla21337, nbla21344, nbla21345 (SEQ ID NO:147), nbla21410 (SEQ ID NO:148), nbla21522 (SEQ ID NO:149), nbla21631 (SEQ ID NO:150), nbla21788 (SEQ ID NO:151), nbla21897 (SEQ ID NO:152), nbla21956, nbla22116 (SEQ ID NO:153), nbla22223 (SEQ ID NO:154), nbla22228, nbla22344 (SEQ ID NO:155), nbla22351, nbla22361, nbla22474, nbla22629, nbla22939 (SEQ ID NO:156), nbla23084 (SEQ ID NO:157), nbla23103 (SEQ ID NO:158), nbla23234 (SEQ ID NO:159), nbla23300 (SEQ ID NO:160), nbla23369 (SEQ ID NO:161), nbla23436 (SEQ ID NO:162), nbla23511 (SEQ ID NO:163), nbla23664 (SEQ ID NO:164), nbla23775, nbla23860 (SEQ ID NO:165), nbla23877 (SEQ ID NO:166), nbla23998 (SEQ ID NO:167), nbla24043 (SEQ ID NO:168), nbla24182, nbla24285, nbla24402 (SEQ ID NO:169), nbla24434, nbla24460, nbla24762, nbla24821 (SEQ ID NO:170), nbla24893, nbla24973, and nbla24986, all of which are novel genes; and nbla20279, nbla20687, nbla20924, nbla21168, nbla21303, nbla21483, nbla21838, nbla21917, nbla22099, nbla22438, nbla23111, nbla23208, nbla24118, nbla24279, nbla24771, and nbla24871, all of which are known genes.

The specific clones belonging to I-3 are as follows: nbla20084 (SEQ ID NO:129), nbla21081 (SEQ ID NO:130), nbla21420 (SEQ ID NO:131), nbla21761, nbla22452 (SEQ ID NO:132), nbla22595 (SEQ ID NO:133), nbla22676 (SEQ ID NO:134), nbla22909 (SEQ ID NO:135), nbla23456, nbla24297, nbla24435 (SEQ ID NO:136), and nbla24719, all of which are novel genes; and nbla20117, nbla20238, nbla20904, nbla23293, nbla23297, nbla23311, nbla23589, nbla23629, nbla23862, nbla2413, and nbla24761, all of which are known genes.

Group II

The genes belonging to this group have expression levels (4s) that are on the same order as those of F, but are higher than those of UF. These genes are further classified into subgroups, resulting in II-1, II-2 and II-3. Table 1 should be consulted on the gene expression pattern of each subgroup.

The specific clones belonging to II-1 are as follows: nbla20365 (SEQ ID NO:117), nbla20378 (SEQ ID NO:118), nbla20511 (SEQ ID NO:119), nbla21039 (SEQ ID NO:120), nbla21107 (SEQ ID NO:121), nbla21367 (SEQ ID NO:122), nbla21790 (SEQ ID NO:123), nbla21855, nbla22253 (SEQ ID NO:124), nbla22355 (SEQ ID NO:125), nbla22704, nbla22832 (SEQ ID NO:126), nbla23394, nbla23512, nbla23755 (SEQ ID NO:127), nbla24084, nbla24376, and nbla24549 (SEQ ID NO:128), all of which are novel genes; and nbla20624, nbla22029, nbla22424, nbla22594 and nbla22622, all of which are known genes.

The specific clones belonging to II-2 are as follows: nbla20001 (SEQ ID NO:58), nbla20083 (SEQ ID NO:59), nbla20125, nbla20182 (SEQ ID NO:60), nbla20231, nbla20248 (SEQ ID NO:61), nbla20250 (SEQ ID NO:62), nbla20268, nbla20330 (SEQ ID NO:63), nbla20395, nbla23973, nbla23983 (SEQ ID NO:64), nbla24041, nbla24082, nbla24104, nbla24111 (SEQ ID NO:65), nbla24142 (SEQ ID NO:66), nbla24157 (SEQ ID NO:67), nbla24230 (SEQ ID NO:68), nbla24239, nbla20541 (SEQ ID NO:69), nbla20555 (SEQ ID NO:70), nbla20638, nbla20645 (SEQ ID NO:71), nbla20713 (SEQ ID NO:72), nbla20765, nbla20789, nbla20792, nbla20798, nbla21024, nbla24250 (SEQ ID NO:73), nbla24254 (SEQ ID NO:74), nbla24327 (SEQ ID NO:75), nbla24363, nbla24510 (SEQ ID NO:76), nbla24554 (SEQ ID NO:77), nbla24604 (SEQ ID NO:78), nbla24622, nbla24646, nbla24672, nbla21037 (SEQ ID NO:79), nbla21077, nbla21089, nbla21130, nbla21161 (SEQ ID NO:80), nbla21170 (SEQ ID NO:81), nbla21198 (SEQ ID NO:82), nbla21266, nbla21298 (SEQ ID NO:83), nbla21379 (SEQ ID NO:84), nbla24705 (SEQ ID NO:85), nbla24709, nbla24748, nbla24831, nbla24972, nbla21385 (SEQ ID NO:86), nbla21413, nbla21416 (SEQ ID NO:87), nbla21520, nbla21599 (SEQ ID NO:88), nbla21681 (SEQ ID NO:89), nbla21878 (SEQ ID NO:90), nbla21922 (SEQ ID NO:91), nbla21936, nbla22004-2 (SEQ ID NO:92), nbla22004-1 (SEQ ID NO:93), nbla22028, nbla22085 (SEQ ID NO:94), nbla22093, nbla22119 (SEQ ID NO:95), nbla22149 (SEQ ID NO:96), nbla22161 (SEQ ID NO:97), nbla22218, nbla22252 (SEQ ID NO:98), nbla22347 (SEQ ID NO:99), nbla22352 (SEQ ID NO:100), nbla22394 (SEQ ID NO:101), nbla22423 (SEQ ID NO:102), nbla22439 (SEQ ID NO:103), nbla22451, nbla22455, nbla22464, nbla22465, nbla22487, nbla22633 (SEQ ID NO:104), nbla22669, nbla22698 (SEQ ID NO:105), nbla22726, nbla22886, nbla22896 (SEQ ID NO:106), nbla23012, nbla23038, nbla23167 (SEQ ID NO:107), nbla23339 (SEQ ID NO:108), nbla23352 (SEQ ID NO:109), nbla23575 (SEQ ID NO:110), 23592 (SEQ ID NO:111), nbla23601 (SEQ ID NO:112), nbla23630 (SEQ ID NO:113), nbla23718, nbla23719, nbla23754 (SEQ ID NO:114), nbla23892 (SEQ ID NO:115), nbla23951, and nbla23956 (SEQ ID NO:116), all of which are novel genes; and nbla20393, nbla20423, nbla20510, nbla20833, nbla20931, nbla20943, nbla21258, nbla21268, nbla21273, nbla21412, nbla21578, nbla21614, nbla21624, nbla21655, nbla21670, nbla21787, nbla21954, nbla21979, nbla22043, nbla22137, nbla22192, nbla22325, nbla22327, nbla22337, nbla22482, nbla22763, nbla22788, nbla22839, nbla22851, nbla22935, nbla22937, nbla23238, nbla23327, nbla23360, nbla23519, nbla23553, nbla23554, nbla23683, nbla23812, nbla23823, nbla23849, nbla23882, nbla23910, nbla24064, nbla24405, nbla24897, and nbla24913, all of which are known genes.

The specific clones belonging to II-3 are as follows: nbla20134, nbla20181, nbla20264 (SEQ ID NO:31), nbla20269 (SEQ ID NO:32), nbla20276, nbla20406 (SEQ ID NO:33), nbla20709, nbla20782, nbla20788, nbla20949 (SEQ ID NO:34), nbla21046, nbla21122, nbla21211, nbla21233, nbla21251 (SEQ ID NO:35), nbla21334 (SEQ ID NO:36), nbla21356 (SEQ ID NO:37), nbla21375, nbla21418 (SEQ ID NO:38), nbla21480 (SEQ ID NO:39), nbla21509 (SEQ ID NO:40), nbla21524, nbla21527 (SEQ ID NO:41), nbla21551 (SEQ ID NO:42), nbla21735 (SEQ ID NO:43), nbla21843, nbla21934, nbla22153, nbla22247 (SEQ ID NO:44), nbla22382, nbla22477 (SEQ ID NO:45), nbla22571, nbla22639 (SEQ ID NO:46), nbla22789, nbla23060, nbla23174 (SEQ ID NO:47), nbla23198 (SEQ ID NO:48), nbla23218, nbla23328 (SEQ ID NO:49), nbla23420 (SEQ ID NO:50), nbla23483 (SEQ ID NO:51), nbla23545, nbla23653, nbla23666, nbla23760, nbla23808 (SEQ ID NO:52), nbla23830, nbla23851 (SEQ ID NO:53), nbla23942, nbla24011 (SEQ ID NO:54), nbla24131, nbla24235 (SEQ ID NO:55), nbla24556 (SEQ ID NO:56), nbla24800 (SEQ ID NO:57), and nbla24908, all of which are novel genes; and nbla20133, nbla20263, nbla20723, nbla20748, nbla20915, nbla21016, nbla21034, nbla21067, nbla21167, nbla21319, nbla21331, nbla21516, nbla21682, nbla21691, nbla21822, nbla21976-2, nbla21977, nbla22159, nbla22168, 22215-1, nbla22244, nbla22263, nbla22548, nbla23033, nbla23231, nbla23284, nbla23329-1, nbla23384, nbla23556, nbla23674, nbla23879-2, nbla24098, nbla24329, nbla24334, nbla24439-1, nbla24443, nbla24507, nbla24836, nbla24958, and nbla24989, all of which are known genes.

Group III

The genes belonging to this group have expression levels (4s) that are on the same order as those of F, but are lower than those of UF. These genes are further classified into subgroups, resulting in III-1, III-2 and III-3. Table 1 should be consulted on the gene expression pattern of each subgroup.

The specific clones belonging to III-1 are nbla20874 (novel gene) and nbla23262 (known gene).

The specific clones belonging to III-2 are as follows: nbla20604, nbla21226, nbla21908 (SEQ ID NO:27), nbla21928, nbla22027 (SEQ ID NO:28), nbla22082 (SEQ ID NO:29), nbla22643, nbla23303(SEQ ID NO:30), nbla23649, and nbla24468, all of which are novel genes; and nbla20141, nbla20446, nbla21538, nbla21558, nbla21623, nbla21969, nbla22219, nbla23272, nbla23307 and nbla24117, all of which are known genes.

The specific clones belonging to III-3 are as follows: nbla20578 (SEQ ID NO:26), and nbla21212, both of which are novel genes; and nbla23478, nbla23896 and nbla24920, all of which are known genes.

Group IV

The genes belonging to this group have expression levels (4s) that are on the same order as those of UF, but are higher than those of F (F<4s=UF). The specific genes belonging to this group are nbla23899 (SEQ ID NO:25) and nbla24526, both of which are novel genes.

Group V

The genes belonging to this group have expression levels (4s) that are lower than those of F, but are higher than those of UF. These genes are further classified into subgroups, resulting in V-1, V-2, V-3, V-4 and V-5. Table 1 should be consulted on the gene expression pattern of each subgroup.

The specific clone belonging to V-1 is nbla22031 (known gene). The specific clone belonging to V-2 is nbla22305 (known gene).

The specific clones belonging to V-3 are as follows: nbla20123 (SEQ ID NO:17), nbla20382 (SEQ ID NO:18), nbla20660 (SEQ ID NO:19), nbla20666 (SEQ ID NO:20), nbla21239 (SEQ ID NO:21), nbla21729 (SEQ ID NO:22), nbla21831 (SEQ ID NO:23), nbla22826 (SEQ ID NO:24), and nbla24521, all of which are novel genes; and nbla20235 and nbla22607, both of which are known genes.

The specific clones belonging to V-4 are nbla20787 (SEQ ID NO:15), nbla22284 (SEQ ID NO:16) and nbla24756, all of which are novel genes.

The specific clones belonging to V-5 are nbla24348 and nbla24686, both of which are novel genes.

Group VI

The genes belonging to this group have expression levels (4s) that are lower than either of F and UF, or are higher than either of F and UF. These genes are further classified into subgroups, resulting in VI-1, VI-2, VI-3, VI-4, VI-5, VI-6, VI-7 and VI-8. Table 1 should be consulted on the gene expression pattern of each subgroup.

The specific clones belonging to VI-1 are nbla21297 (SEQ ID NO:14) (novel gene) and nbla22443 (known gene).

The specific clones belonging to VI-2 are as follows: nbla20211, nbla20469, nbla21250, nbla22182 (SEQ ID NO:12), nbla22761, nbla23256 (SEQ ID NO:13), nbla23631, nbla23711, nbla24532, and nbla24951, all of which are novel genes; and nbla21750, nbla22129, nbla22808, nbla23064, and nbla23358, all of which are known genes.

The specific clone belonging to VI-3 is nbla20226 (SEQ ID NO:11) (novel gene).

The specific clones belonging to VI-4 are nbla21650 (SEQ ID NO:7), nbla22094 (SEQ ID NO:8), nbla22739 (SEQ ID NO:9), and nbla23525 (SEQ ID NO:10), all of which are novel genes.

The specific clones belonging to VI-5 are nbla23701 (SEQ ID NO:5) and nbla23890 (SEQ ID NO:6), both of which are novel genes.

The specific clone belonging to VI-6 is nbla20087 (known gene).

The specific clones belonging to VI-7 are nbla22689 (SEQ ID NO:2), nbla22968, nbla24079, nbla24135 (SEQ ID NO:3), and nbla24350 (SEQ ID NO:4), all of which are novel genes.

The specific clone belonging to VI-8 is nbla22256 (novel gene).

Group VII

The gene belonging to this group (only one) is expressed only in 4s. The specific clone is nbla22420 (SEQ ID NO:1) (novel gene).

The gene groups have been divided into novel genes and known genes with respect to each group. A summary is shown in Table 1.

TABLE 1

| Group | Expression pattern | Novel genes | Known genes | Total |
| --- | --- | --- | --- | --- |
| I-1 | F >> 4s = UF | 5 | 0 | 5 |
| I-2 | F > 4s = UF | 59 | 16 | 75 |
| I-3 | F ≧ 4s = UF | 12 | 11 | 23 |
| II-1 | F = 4s >> UF | 18 | 5 | 23 |
| II-2 | F = 4s > UF | 105 | 47 | 152 |
| II-3 | F = 4s ≧ UF | 55 | 40 | 95 |
| III-1 | F = 4s << UF | 1 | 1 | 2 |
| III-2 | F = 4s < UF | 10 | 10 | 20 |

TABLE 1-continued

| Group | Expression pattern | Novel genes | Known genes | Total |
|---|---|---|---|---|
| III-3 | F = 4s < UF | 2 | 3 | 5 |
| IV | F < 4s = UF | 2 | 0 | 2 |
| V-1 | F > 4s >> UF | 0 | 1 | 1 |
| V-2 | F ≧ 4s >> UF | 0 | 1 | 1 |
| V-3 | F > 4s > UF | 9 | 2 | 11 |
| V-4 | F ≧ 4s > UF | 3 | 0 | 3 |
| V-5 | F ≧ 4s ≧ UF | 2 | 0 | 2 |
| VI-1 | F >> 4s < UF | 1 | 1 | 2 |
| VI-2 | F > 4s < UF | 10 | 5 | 15 |
| VI-3 | F > 4s ≦ UF | 1 | 0 | 1 |
| VI-4 | F ≧ 4s ≦ UF | 4 | 0 | 4 |
| VI-5 | F < 4s >> UF | 2 | 0 | 2 |
| VI-6 | F ≦ 4s >> UF | 0 | 1 | 1 |
| VI-7 | F < 4s > UF | 5 | 0 | 5 |
| VI-8 | F ≦ 4s ≧ UF | 1 | 0 | 1 |
| VII | 4s only | 1 | 0 | 1 |
| Total clone number | | 308 | 144 | 452 |

In the table and the above classification, "=" shows that the gene expression levels are nearly equal between the subsets.

Specifically, with respect to a group of genes belonging to group VI, when their expression levels in the stage 4s neuroblastoma and the expression levels of the same genes in clinical samples of the neuroblastomas of the favorable and unfavorable prognosis types are compared, they are specific in the stage 4s neuroblastoma: that is, their expression levels are significantly higher or lower than in either type of neuroblastomas. Therefore, if the presence of at least one of those genes is detected in a clinical tissue sample, it can be judged that there is a high probability of the sample being stage 4s neuroblastoma.

The gene belonging to Group VII is detected only in a clinical tissue of stage 4s neuroblastoma. Therefore, if the presence of this gene is detected in a clinical tissue sample, it can be judged that there is a high probability of the sample being stage 4s neuroblastoma.

Further, with respect to a group of genes belonging to one of the remaining groups, when their expression levels in the stage 4s neuroblastoma and the expression levels of the same genes in clinical samples of the neuroblastomas of the favorable and unfavorable prognosis types are compared, the expression patterns as described above can be found. Therefore, if plural expression patterns of those genes are detected and analyzed, it can be judged as to whether the clinical tissue sample to be assayed is stage 4s neuroblastoma. Particularly, when the nucleic acids of this invention are used for this purpose, it is preferred that a nucleic acid microarray (which will be described below) be constructed and provided for determining neuroblastomas.

Thus, the nucleic acids of this invention are useful as tumor markers to diagnose the favorable or unfavorable prognosis of neuroblastoma. Specifically, this invention will allow for providing various genetic information on or relating to the prognosis of human neuroblastoma through the following means.

(1) Probes for Use in Hybridization

According to one embodiment of this invention, the nucleic acid of the invention can be used as a probe (the nucleic acid probe of this invention) for hybridization to detect the gene of the invention expressed in neuroblastoma. The nucleic acid of this invention can also be used as a probe for hybridization in order to determine gene expression in various tumors and normal tissues, to identify the distribution of the gene expression.

When the nucleic acid of this invention is used as a probe for hybridization, there are no particular limitations on the actual method of hybridization. As preferred methods there may be mentioned, for example, Northern hybridization, Southern hybridization, colony hybridization, dot hybridization, fluorescence in situ hybridization (FISH), in situ hybridization (ISH), DNA chip methods, and microarray methods.

As one application example of the hybridization methods, the nucleic acid of this invention can be used as a probe for Northern hybridization to measure the length of mRNA or to quantitatively detect gene expression in a clinical tissue sample to be assayed.

As another application example, the nucleic acid of this invention can be used as a probe for Southern hybridization to detect the presence or absence of a DNA sequence in the genomic DNA of a clinical tissue sample to be assayed.

As still another application example, the nucleic acid of this invention can also be used as a probe for the FISH method to identify the location of a gene of the invention on a chromosome.

As a further application example, the nucleic acid of this invention can also be used as a probe for the ISH method to identify the tissue distribution of expression of a gene of the invention.

When the nucleic acid of this invention is used as a probe for hybridization, a base length of at least 20 is necessary; and among the nucleic acids of this invention, a nucleic acid comprising 20 or more contiguous bases is preferably used. More preferably, the nucleic acid comprising 40 or more contiguous bases is used and most preferably a nucleic acid comprising 60 or more contiguous bases is used. Further, there may be used a nucleic acid comprising the full-length of any of the nucleic acid sequences set forth in SEQ ID NO:1 to SEQ ID NO:174 in the Sequence Listing.

The nucleic acid probe techniques in the various hybridization methods described above are well known to one skilled in the art, and for example, the conditions suitable for hybridization between a probe of this invention with each individual base length and the target polynucleotide may be readily determined. In order to obtain hybridization conditions optimal to probes containing varying base lengths, Sambrook et al. "Molecular Cloning: A Laboratory Manual" (loc. cit.) may be consulted and followed for such manipulations which are well known to one skilled in the art.

The probe of this invention may preferably be labeled for use in an easily detectable fashion. The detectable label may be any type and any element or compound which can be detected either visually or using devices. As commonly used detectable labels, there may be mentioned radioactive isotopes, avidin and biotin and fluorescent substances (FITC or Rhodamins). The radioactive isotopes are $^{32}P$, $^{14}C$, $^{125}I$, $^{3}H$, $^{35}S$ etc. Biotin-labeled nucleotides may be incorporated into nucleic acids by nick translation, or chemical or enzymatic means. The biotin-labeled probes are detected after hybridization using labeling means such as avidin/streptavidin, fluorescent labels, enzymes, gold colloidal complexes or the like. The nucleic acid probe of this invention may also be labeled by binding with a protein. For this purpose, a radioactive or fluorescent histone single-stranded binding protein may be used, for example. In this manner, a suitably labeled probe constitutes a diagnostic agent of this invention.

(2) Primers for Use in PCR

In order to detect the gene of this invention other than through the hybridization, primers can be designed after any nucleic acid (DNA) sequence contained in the nucleic acid of the invention and the polymerase chain reaction (PCR) method can be used. For example, mRNA may be extracted from a clinical tissue sample to be assayed, and the gene expression can be semi-quantitatively measured by RT-PCR. Such method may be carried out by a method well known to one skilled in the art. For example, "Molecular Cloning: A Laboratory Manual," (loc. cit.) and or Idenshibyo Nyumon [Introduction to Genetic Diseases] (Takahisa, S.: Nankodo Publishing) may be consulted.

When the nucleic acid (DNA) of this invention is used as a PCR primer (i.e., the primer of the invention), a base length of 10 to 60 is necessary; and among portions of the nucleic acid sequences according to the invention, the nucleic acid having 10 to 60 contiguous bases is preferably used. More preferably, one having 15 to 30 bases is used. Generally, a primer sequence with a GC content of 40-60% is preferred. Also, there should preferably be no difference in the Tm values of the two primers used for amplification. Desirably, the primers do not anneal at their 3'-ends and do not adopt any secondary structures within the primers.

(3) Gene Screening

The nucleic acid of this invention can also be used to detect the expression (or the distribution) of a gene of the invention which is expressed in various tissues or cells, non-limiting to neuroblastoma. This can be accomplished, for example, by using the nucleic acid of this invention as a probe for hybridization or as a primer for PCR as described above.

The expression distribution of the gene can also be detected using a DNA chip, a nucleic acid microarray or the like. That is, the nucleic acid of the invention may be directly attached to the chip or array. There is known a method by which nucleic acids (DNA) are spotted to a substrate for the purpose of attaching them to a chip or array by using a high precision dispenser (see, for example, U.S. Pat. No. 5,807,522). mRNA extracted from a clinical tissue sample may be labeled with a fluorescent substance or the like, hybridized thereto, and an analysis can be made of the type of tissue cells with high expression of the gene. The DNA attached to the chip or the array may be the reaction product of PCR using the nucleic acid or its fragment of this invention. As an alternative method, the nucleic acid fragment of this invention (DNA fragment) may be directly synthesized on a substrate to form a DNA chip or a DNA array (see, for example, U.S. Pat. No. 5,424,186).

(4) DNA Cloning

The nucleic acid of this invention can be used for cloning a gene which is expressed in human neuroblastoma. For example, by using the nucleic acid of the invention as a probe for Northern hybridization or colony hybridization, or as a primer for PCR, cloning of a gene containing the nucleic acid of the invention is possible. The genes capable of being cloned include, among others, genes displaying differential expression levels between neuroblastomas of the unfavorable prognosis type and neuroblastomas of the unfavorable prognosis type, genes expressed in stage 4s neuroblastoma, genes displaying expression in a pattern different from the expression patterns in other tissues or cancer cells, genes expressed in a cell cycle dependent manner, genes induced by nerve differentiation, and genes whose expression is regulated by oncogenes or cancer suppressor genes.

(5) Methods for Diagnosing Tumor Prognosis and Tumor Markers to be Used Therefore As mentioned above, expression of the gene of this invention was found in stage 4s neuroblastoma (including neuroblastomas of the favorable and unfavorable prognosis types). Therefore, the nucleic acid of this invention can be used as a probe for hybridization, or as a primer for PCR to investigate the expression pattern of the gene in a clinical tissue sample to be assayed taken from the subject, which enables the diagnosis for prognosis (i.e., determining stage 4s neuroblastoma). The methods of detecting the gene include Northern blotting hybridization, in situ hybridization and RT-PCR, as mentioned above among others.

When hybridization is employed, the amount of the nucleic acid hybridizing to the nucleic acid probe mentioned above in a clinical tissue sample to be assayed is compared with the control sample (e.g., clinical tissue samples from neuroblastomas of the favorable and unfavorable prognosis types) and the gene expression is determined. For the respective nucleic acids used to detect the gene expression patterns, their expression patterns may then be, for example, compared with those listed in Table 1 and analyzed to enable the diagnosis for prognosis. For this purpose, the nucleic acid microarray mentioned above may desirably be used. When RT-PCR is employed instead, mRNA is extracted from the sample and reverse-transcribed into DNA, amplification is performed using the aforementioned primers, and the gene expression is semi-quantitatively measured. Similarly to the manner mentioned above, the diagnosis for prognosis can be made. For this purpose, it is preferred to utilize a diagnostic kit containing a pair of the primers as essential components. In addition to the primer components, the diagnostic kit also includes known components such as PCR buffer, detergent solution and enzymes.

(6) Antisense Oligonucleotides

According to another embodiment of this invention, there are provided antisense oligonucleotides to the nucleic acids of the invention. The antisense oligonucleotides are capable of hybridizing to the nucleic acids of this invention, and include antisense DNAs and antisense RNAs. Antisense DNA inhibits transcription of mRNA from DNA, while antisense RNA inhibits translation of mRNA. These antisense oligonucleotides may be synthesized using an automated synthesizer or by PCR using the nucleic acids of this invention as templates. The antisense oligonucleotides also encompass antisense oligonucleotide derivatives having improved binding affinity for DNA or mRNA, tissue selectivity, cell permeability, nuclease resistance and intracellular stability. These derivatives may be synthesized using the antisense technology known in the art.

Antisense oligonucleotides having sequences complementary to the sequences near the translation initiation codon of the mRNA, those of the ribosome-binding site, and those of the capping site or the splicing site are capable of inhibiting synthesis of the RNA, and therefore, will exhibit a particularly notable inhibitory effect on gene expression. This invention, therefore, encompasses such antisense oligonucleotides.

(7) Gene Therapy

According to a further embodiment of this invention, there are provided nucleic acid sequences encoding the therapeutic genes to be used in gene therapy. Thus, the nucleic acid of this invention can be transferred into a vector for use in gene transportation, whereby the transgene (i.e., the gene of the invention) can be expressed by an arbitrary expression promoter and can be used for the gene therapy.

1. Vectors

The transferable viral vectors may be prepared from DNA or RNA viruses. Such vectors may be any type of viral vectors from an MoMLV vector, a herpes virus vector, an Adenovirus vector, an AAV vector, a HIV vector, a SIV vector, a Sendai virus vector and the like. One or more proteins among the constituent protein group of a viral vector are substituted by the constituent proteins of a different species of virus, or alternatively a part of the nucleic acid sequence constituting genetic information is substituted by the nucleic acid sequence of a different species of virus to form a viral vector of the pseudo-type, which can also be used in this invention. For example, there is mentioned a pseudo-type viral vector wherein the Env protein (an envelop protein of HIV) is substituted by the VSV-G protein (an envelop protein of vesicular stomatitis virus or VSV) (Naldini L., et al., Science vol. 272, p. 263, 1996). Further, viruses having a host spectrum other than humans are usable as the viral vector insofar as they are efficacious. As for the vectors other than those of viral origin, there may be used complexes of calcium phosphate and nucleic acid, ribosomes, cation-lipid complexes, Sendai virus liposomes, polymer carriers having polycation as the backbone main chain and others. In addition, methods such as electroporation and gene guns may be used as a gene transfer system.

2. Expression Promoters

As for the expression cassettes to be used for the therapeutic gene, any cassettes without any particular limitations may be used insofar as they can cause genes to express in the target cells. One skilled in the art can readily select such expression cassettes. Preferably, they are expression cassettes capable of gene expression in the cells derived from an animal, more preferably, expression cassettes capable of gene expression in the cells derived from a mammal, and most preferably expression cassettes capable of gene expression in the cells derived from human. The gene promoters that can be used as expression cassettes include: for example, virus-derived promoters from an Adenovirus, a cytomegalovirus, a human immunodeficiency virus, a simian virus 40, a Rous sarcoma virus, a herpes simplex virus, a murine leukemia virus, a sinbis virus, a hepatitis type A virus, a hepatitis type B virus, a hepatitis type C virus, a papilloma virus, a human T cell leukemia virus, an influenza virus, a Japanese encephalitis virus, a JC virus, parbovirus B19, a poliovirus, and the like; mammal-derived promoters such as albumin, SR α, a heat shock protein, and an elongation factor; chimera type promoters such as a CAG promoter; and the promoters whose expression can be induced by tetracyclines, steroids and the like.

3. Drugs

The drugs to be used in the gene therapy may be prepared as a recombinant viral vector containing the therapeutic gene that is designed for therapeutic purposes as described above. More specifically, a recombinant virus vector containing the gene of this invention may be prepared by dissolving it in an appropriate solvent such as water, physiological saline or an isotonized buffer solution. Here, polyethylene glycol, glucose, various amino acids, collagen, albumin or the like can be then added as protective materials to form preparations.

4. Administration Method and Dosage

There are no particular limitations on the method of administrating the drug mentioned above to humans. For example, parental administration, including injection is preferably carried out. The use level of the drug varies depending on the method of use, the purpose of use, etc.; and one skilled in the art can easily select as appropriate and optimize it. In the case of injection, for example, the daily dosage is preferably administered at about 0.1 μg/kg to 1,000 mg/kg per day, and more preferably at about 1 μg/kg to 100 mg/kg per day.

This invention will be described hereafter in greater detail by way of the examples; however, the technical scope of the invention will not be restricted to those examples.

EXAMPLES

The invention will be described hereafter based on the examples more concretely; however, the invention will not be restricted to the examples described below.

Preparation Example 1

Construction of cDNA Library from Neuroblastoma

1. Obtaining Samples

Clinical tissue samples of human neuroblastoma (stage 4s) were quasi-aseptically frozen immediately after surgical extraction and then preserved at −80° C.

2. Preparation of mRNA

A 2-3 g portion of the sample described in 1 was treated with a Total RNA Extraction Kit (QIAGEN Inc.) and the total RNA was extracted. The extracted total RNA was purified using an oligo dT cellulose column (Collaborative Research, Inc.) to obtain a pool of mRNA with a polyA structure. Following the procedure described below, a cDNA library was prepared according to the oligo capping method (Y. Suzuki et al., Gene, U.S.A., Vol. 200, pp. 149-156, 1997).

3. Dephosphorylation of mRNA

A 100-200 μg portion of the mRNA pool prepared in 2 above was dissolved in 67.3 μl of sterile ultra-purified water containing 0.1% diethyl pyrocarbonate (DEPC) (DEPC—$H_2O$), and then 20 μl of 5×BAP buffer [Tris-HCl (500 mM, pH=7.0)/mercaptoethanol (50 mM)], 2.7 μl of RNasin (40 unit/μl: Promega Inc.) and 10 μl of BAP (0.25 unit/μl, bacteria-derived alkali phosphatase: Takara Shuzo Co. Ltd.) were added. The mixture was reacted at 37° C. for 1 hour to effect dephosphorylation of the 5' end of the mRNA. This was followed by phenol/chloroform treatment twice, and finally by ethanol precipitation to obtain a purified dephosphorylated mRNA pool.

4. Decapping of Dephosphorylated mRNA

The total amount of the dephosphorylated mRNA pool prepared in 3 above was dissolved in 75.3 μl of sterile ultra-purified water containing 0.1% DEPC, and then 20 μl of 5×TAP buffer [sodium acetate (250 mM, pH=5.5)/mercaptoethanol (50 mM), EDTA (5 mM, pH=8.0)], 2.7 μl of RNasin (40 unit/μl) and 2 μl of TAP (tobacco acid pyrophosphatase: 20 unit/μl) were added. The mixture was reacted at 37° C. for 1 hour to effect decapping treatment of the 5' end of the dephosphorylated mRNA. The dephosphorylated mRNA of incomplete length with no capped structure remained without decapping, and with the 5' end dephosphorylated. This was followed by phenol/chloroform treatment and ethanol precipitation to obtain a purified decapped mRNA pool.

5. Preparation of Oligo-Capped mRNA

The total amount of the decapped mRNA pool prepared in 4 above was dissolved in 11 μl of sterile ultra-purified water containing 0.1% DEPC, and then 4 μl of 5'-oligo RNA (5'-AGCAUCGAGUCGGCCUUGGCCUACUGG-3': SEQ ID NO:1079; 100 ng/μl), 10 μl of 10×ligation buffer [Tris-HCl (500 mM, pH=7.0)/mercaptoethanol (100 mM)], 10 μl of magnesium chloride (50 mM), 2.5 μl of ATP (24 mM), 2.5 μl of RNasin (40 unit/μl), 10 μl of T4 RNA ligase (25 unit/μl: Takara Shuzo Co. Ltd.) and 50 μl of polyethylene glycol (50% w/v, PEG8000: Sigma Corporation) were added. The mixture was reacted at 20° C. for 3 hours for ligation of the 5'-oligo RNA to the 5' end of the decapped mRNA. The dephosphorylated mRNA of incomplete length with no capped structure resulted in no ligation to the 5'-oligo RNA. This was followed by phenol/chloroform treatment and ethanol precipitation to obtain a purified oligo-capped mRNA pool.

6. Removal of DNA from Oligo-Capped mRNA

The oligo-capped mRNA pool prepared in 6 above was dissolved in 70.3 μl of sterile ultra-purified water containing 0.1% DEPC, and then 4 μl of Tris-HCl (1 M, pH=7.0), 5.0 μl of DTT (0.1 M), 16 μl of magnesium chloride (50 mM), 2.7 μl of RNasin (40 unit/μl) and 2 μl of DNaseI (5 unit/μl: Takara Shuzo Co. Ltd.) were added. The mixture was reacted at 37° C. for 10 minutes to digest the excess DNA. This was followed by phenol/chloroform treatment and ethanol precipitation and column purification (S-400HR: Pharmacia Biotech Inc.), to obtain a purified DNA(−) oligo-capped mRNA pool.

7. Preparation of 1st Strand cDNA

The DNA(−) oligo-capped mRNA pool prepared in 7 above was reverse-transcribed using Super Script II (kit manufactured by Life Tech Oriental, Inc.) to obtain a pool of 1st strand cDNA.

The pool of DNA(−) oligo-capped mRNA was dissolved in 21 μl of sterile distilled water, and then 10 μl of 10×First Strand buffer (kit accessory), 8 μl of dNTP mix (5 mM, kit accessory), 6 μl of DTT (0.1 M, kit accessory), 2.5 μl of oligo-dT adapter primer (5 pmol/μl, 5'-GCGGCTGAA-GACGGCCTATGTGGCCTTTTTTTTTTTTTTTTT-3': SEQ ID NO:1080), 2.0 μl of RNasin (40 unit/μl) and 2 μl of Super Script II RTase (kit accessory) were added. The mixture was reacted at 42° C. for 3 hours to effect reverse transcription. This was followed by phenol/chloroform treatment, alkali treatment and neutralization treatment to digest all the RNA and purification was carried out by ethanol precipitation.

8. Preparation of 2nd Strand cDNA

The 1st strand cDNA pool prepared in 7 above was subjected to PCR amplification using Gene Amp (kit manufactured by Perkin Elmer Inc.). The pool of 1st strand cDNA was dissolved in 52.4 μl of sterile distilled water, and then 30 μl of 3.3× Reaction buffer (kit accessory), 8 μl of dNTP mix (2.5 mM, kit accessory), 4.4 μl of magnesium acetate (25 mM, kit accessory), 1.6 μl of Primer F (10 pmol/μl, 5'-AGCATC-GAGTCGGCCTTGTTG-3': SEQ ID NO:1081), 1.6 μl of Primer R (10 pmol/μl, 5'-GCGCTGAAGACGGCCTATGT-3': SEQ ID NO:1082) and 2 μl of rTth (kit accessory) were added. Mineral oil (100 μl) was gently added to the mixture and overlayed thereon. After denaturing the reaction solution at 94° C. for 5 minutes, a cycle of 94° C. for 1 minute, 52° C. for 1 minute and 72° C. for 10 minutes was repeated 12 times, and then the solution was allowed to stand at 72° C. for 10 minutes to complete the PCR reaction. This was followed by purification with phenol/chloroform treatment and ethanol precipitation to obtain a 2nd strand cDNA pool.

9. SfiI Treatment of 2nd Strand cDNA

The 2nd strand cDNA pool prepared in 8 above was dissolved in 87 μl of sterile distilled water, and then 10×NEB buffer (NEB Inc.), 100×BSA (bovine serum albumin manufactured by NEB Inc.) and 2 μl of SfiI (restriction endonuclease, 20 unit/μl, manufactured by NEB Inc.) were added. The mixture was reacted overnight at 50° C. to effect SfiI restriction endonuclease treatment. This was followed by purification with phenol/chloroform treatment and ethanol precipitation to obtain a pool of cDNA which had been SfiI-treated at both ends.

10. Size Fractionation of SfiI-Treated cDNA

The SfiI-treated cDNA pool prepared in 9 above was electrophoresed on 1% agarose gel and a fraction with >2 kb was purified using Geneclean II (Bio101 Inc.). The purified cDNA pool was dissolved in 100 μl of sterile distilled water and allowed to stand at 37° C. for 6 hours. This was followed by purification with phenol/chloroform treatment and ethanol precipitation to obtain a long-chain cDNA pool.

11. cDNA Library

The long-chain cDNA pool prepared in 10 above was ligated into the cloning vector pME18S-FL3 (provided by Prof Sumio Kanno of the Institute of Medical Science, Tokyo University) using a DNA Ligation Kit ver.1 (kit manufactured by Takara Shuzo Co. Ltd.). The long-chain cDNA pool was dissolved in 8 μl of sterile distilled water, and then 1 μl of pME18S-FL3 pretreated with restriction endonuclease DraIII, 80 μl of Solution A (kit accessory) and 10 μl of Solution B (kit accessory) were added and reaction was conducted at 16° C. for 3 hours. This was followed by purification with phenol/chloroform treatment and ethanol precipitation to obtain a cDNA library.

Example 1

Transformation into *E. coli*

1. Cloning

The cDNA library prepared in Preparation Example 1, Item 12 above was used for transformation into *E. Coli* (TOP-10: Invitrogen Corporation). Specifically, the cDNA library was dissolved in 10 μl of sterile distilled water and mixed with TOP-10. The mixture was then incubated on ice for 30 minutes, at 40° C. for 1 minute and on ice for 5 minutes. After adding 500 μl of SOB medium, shake culturing was performed at 37° C. for 60 minutes. Appropriate amounts thereof were seeded onto an ampicillin-containing agar media and culturing was continued at 37° C. for 24 hours to obtain *E. Coli* clones. There, 5075 clones were picked up randomly.

2. Preservation of *E. coli* Clones (Preparation of Glycerol Stock)

The *E. coli* clones on agar media obtained in 1 above were collected with toothpick and suspended in 120 μl of LB medium prepared in a 96-well plate. The 96-well plate was then allowed to stand overnight at 37° C. for culturing of the *E. coli*. 60% Glycerol solution (72 μl) was then added and preserved at −20° C. (glycerol stock).

Example 2

Nucleic Acid Sequencing

1. Preparation of Plasmid

The glycerol stock (10 μl) prepared in Example 1, Item 2 above was transferred to a 15 ml-centrifugation tube, and then 3 ml of LB medium and 50 μg/ml of ampicillin were added and shaking was carried out overnight at 37° C. for culturing of the *E. coli*. A QIAprep Spin Miniprep Kit (QIAGEN Inc.) was then used to extract and purify a plasmid DNA from the *E. coli*.

2. Analysis of Both End Sequences

Both end sequences of the plasmid DNA prepared in 1 above were determined using a DNA Sequencing Kit (kit manufactured by ABI). There were combined 600 ng of plasmid DNA, 8 μl of premix (kit accessory) and 3.2 μmol of primers, and sterile distilled water was added to a total of 20 μl. After denaturing the mixture at 96° C. for 2 minutes, a cycle of 96° C. for 10 seconds, 50° C. for 5 seconds and 60° C. for 4 minutes was repeated 25 times for reaction. The product was then purified by ethanol precipitation. Sequence determination was carried out by polyacrylamide gel electrophoresis under denaturing conditions, using ABI377 (ABI).

An internet-mediated DNA sequence homology search was conducted for DNA sequence data obtained from the both end-sequence analysis in Example 2. The search was conducted using the BLAST database of the NCBI (National Center of Biotecbnology Information. As a result of the homology search, approximately 2,700 genes were identified. These genes were classified and repeat sequences were eliminated using a RepeatMasker software to obtain 1598 genes. Out of the genes, 963 genes were novel and 635 genes were known.

With respect to 308 of novel genes among those genes, those which could be sequenced are shown in the Sequence Listing with their partially decoded sequences.

Example 4

Comparison of Gene Expression Levels by Semi-quantitative PCR

1. Obtaining Samples

Clinical tissue samples of human neuroblastoma (stage 4s) were quasi-aseptically frozen immediately after surgical extraction and then preserved at −80° C. These samples were provided in 8 specimens. In a similar manner, clinical tissue samples of human neuroblastomas of the favorable and unfavorable prognosis types were provided in 12 specimens each.

Prognosis assay of the neuroblastoma samples of the favorable and unfavorable prognosis types was carried out based on the following criteria:

Favorable prognosis type:
Stage 1 or 2
Age of onset: <1
Survival for ≧5 years after surgery without recurrence
No amplification of N-myc
Unfavorable prognosis type:
Stage 4
Age of onset: ≧1
Death within 3 years after surgery
Amplification of N-myc 2. Differential Screening Semi-quantitative RT-PCR of each specimen was performed in the manner described below.

a) Reverse Transcription (RT)

The RNA from the specimen was reverse-transcribed into cDNA using Super Script II reverse transcriptase (GIBCO). Specifically, 48 μl of a solution comprising 20 μg of the total RNA, 8 μl of random primers (1 μg/μl) (Takara Shuzo Co., Ltd.), and sterile ultra-purified water containing DEPC in an amount as necessary was prepared. This solution was incubated at 65° C. for 15 minutes and was placed on ice after the reaction was complete. Sterile ultra-purified water containing 24 μl of 5×first strand buffer (GIBCO), 12 μl of 0.1 M DTT (GIBCO), 30 μl of dNTPs (Takara Shuzo Co., Ltd.), 4 μl of Super Script II reverse transcriptase and 2 μl of DEPC were mixed to prepare 72 μl of a mixed solution. This mixed solution was added to the ice-cooled solution described above to make a total of 120 μl, and was allowed to react at 42° C. for 1.5 hours and then at 95° C. for 5 minutes. This was preserved at −20° C., which was provided for the mother liquor of PCR template.

Thus prepared cDNA solution was diluted with DDW to an appropriate dilution and then it was normalized (concentrations adjusted) with GAPDH primers. The base sequences of the GAPDH primers used were as follows:

```
5'-ACCTGACCTGCCGTCTAGAA-3'
(forward: SEQ ID NO:1077)
and

5'-TCCACCACCCTGTTGCTGTA-3'.
(reverse: SEQ ID NO:1078)
```

Subsequently, each sample with its concentration adjusted by dilution with DDW was subjected to PCR as described below.

b) PCR

PCR was performed with rTaq polymerase (Takara Shuzo Co., Ltd.). Appropriate primers were designed against the genes (whether novel or known) identified in the cDNA library from the stage 4s neuroblastoma. Differential screening of three pairs of cDNA sample populations with their concentrations adjusted was performed. Specifically, 2 μl of cDNA, 5 μl of sterile distilled water, 1 μl of 10×rTaq buffer, 1 μl of 2 mM dNTPs, 0.5 μl each of the synthesized primer set (forward and reverse), and 0.5 μl of rTaq were combined. After denaturing this mixture at 95° C. for 2 minutes, a cycle of 95° C. for 15 seconds, 58° C. for 15 seconds and 72° C. for 20 seconds was repeated 35 times, and then the mixture was allowed to stand at 72° C. for 20 minutes, thereby performing PCR. Where no band showed up, PCR conditions were studied by increasing the number of cycles. Thus, annealing temperatures and cycle numbers for the respective primers could be determined.

The PCR products under thus determined conditions were electrophoresed on 1.5% agarose gel for 20 minutes, stained with ethidium bromide. The concentrations of the bands were compared among three pairs of specimens (i.e., stage 4s neuroblastoma, neuroblastomas of the favorable and unfavorable prognosis types).

As previously described, Table 1 summarizes the obtained patterns according to the specimen subsets. Results from the expressed pattern analysis are as previously discussed.

The primers used were selected under suitable primer selection conditions (base number, Tm, GC %) by inputting into a Primer3 software, the end sequences of the genes to be detected (Example 3). The primer sequences corresponding to the specific clones previously described are provided in the Sequence Listing (SEQ ID NO:175 to SEQ ID NO:1076).

INDUSTRIAL APPLICABILITY

As described above, by utilizing the information obtainable from the genes or the nucleic acids of this invention, the genes are detected in a clinical tissue sample to be assayed thereby to allow the diagnosis for prognosis of neuroblastoma (principally for determining stage 4s neuroblastoma). Specifically, the information obtainable form the genes or the nucleic acids is utilized as tumor markers to allow the preparation of diagnostic agents as well as the design of diagnostic microarrays, both of which can be used for the diagnosis of prognosis.

If the accurate diagnosis of stage 4s neuroblastoma can be made, it will be important information in deciding whether or not the patient in question needs treatment. Where the case warrants, an unnecessary surgical operation may be avoided.

SEQUENCE LISTING (1082 sequences)

SEQ ID NO: 1 - DNA, 1570 bp, Homo sapiens
  nbla22420
aatggaaacacagagcgtgttttctgaccacacttgtaaatagaattatgagcataactttttttgtacttaaagtttgccctaggcatatacaagtcagttcttctaagcaagatagtttcagttaaatgttgttatttgcttttggatagcctttgatcatatggacagaaataaatcaggtataataaaacacacacaaagtattccagaaaaaattgtatttgtttttgactaataagtaaatacaactatttttcttggtttgtattagtttttagatatttttgaaagaatggattcaatcttttaaaaattaagaggtaactgatttatgaacacagattaacaatcattttgagacattaaaaataccatctgtacatgagaaaattataatggtaatcaacaaaatttcagtacttcccagaatctggttttgaaactttattatgttttaggggaaaagctctcatttttctgtttgcttagatgagttagatcactcatttaaaatctgaagaagtcaaattattttttataaagatccagaataatagtgtatgtatttctaaataatctgaatatgtttacattggttttttttttttaaacctaggctaggaagggattacctattatctaacaaacatagtgcaactgtatagataaggggcaaacttcaaagattggatattgtttattatgtgaaagatacataggtctggctatgatttggaagtcctaggtaactggttaggcttttcaggattgacagcagctgtgcagaaattttgttaaatgcttatcattttaaaaagctgtattcaaaatatttctaattttcactattttttaatgtaaatgtttttgagagtcaaagaagattctatacttttacttatgaagcagtttgttgttgtttgttcatttctttttttggtatggggtctttctctgttgcccaaggccggagtatgtagtggtgcaatcacagctcgctgcaggcttaaactcctggtctcaagccatttttctgcctcagcctttctagtagctgggagtacaggcaaatgctactgccccaagctaatttatgttttatttttattttttgtagagacagggtctcgctgtgttgtgcaggctgatctctaactcctgggctcaagctatctccccactttgcctcctcaagtgttgggtttataggcgtgagctatggtgcccagcctgaggcagtcttaacgataatttgttttttctgatcaaaatctaccaaaatggccggctgcgctggctcacgcctgtaatcccagtactttgagagaccgaggtgggtggatctcttgaggtcaggagtccaagaccagcctggcaaacatggtgaaaccccgtctctactaaaaatacaaaatagccgggcatggtggcatgcacctgtaattccagctactcgggagactgaggcaggagaattacttgaacccaggaggtggaggttgtagcaagccaagatcacgccactgcattccagcctgggcgacagagtgagactctgtctcaaaaa

SEQ ID NO: 2 - DNA, 2400 bp, Homo sapiens
  nbla22689
gaaaacaaaaggagacgaaggacgcatgcgtttggtgagtcccggattctggtgggttcttccgctcaggctgggtgaagcgcttccgggtcgccgccggcagcagcctcccggcgcgatgaagacactgaggctcagagaggttaagtgactcagccaaggtcaaacagctagtaagtggtggagccaggactcaaagccaggagccatgtccactttgttcccctcactcttccctcgtgtgactgagactctgtggtttaatctggatcgaccctgtgtggaagagacagagctgcagcagcaggaacagcagcatcaggcctggctccaaagcatcgcggagaaagacaacaacctggttcctattggcaagccagcctcagaggcctgtagggcttacaggctctgtcctgcccaccagcactatgatgacgaggaagaagaggatgatgaagatgatgaggatagtgaagaggactcagaggatgatgaggatatgcaggacatggacgagatgaatgactacaatgagtcaccggatgatggagaggtcaatgaggtaggcaaggggtatgggggagggcctctgttcctggacccttgctcctgacccagttgatggccaaggggtacagaaaccctggatccagccaggggcaggatctggggctgaggctggctgaggcccctccccacccacacccagcctcctctccaggtggacatggaaggcaacgaacaggatcaggaccagtggatgatctaggtagagtatccacagtaggttcccaattccagcacacaagcaggggccttctcctccaccagccgcatcaggatctgacctatgaggggagatggctgttgcagaagacatgggagatggatgcagggcccctgataaaagatatctcaaatgcctacctgcctcactgcagctcccaaccagccggggtctcatctgtctcttgtaccatagccccagctgccctcctggtccccgtctcctacagtgtagtcttcacaccagccctggaatttttccaacaaatctgaccttattactccttggctcctgtgagctgaaggcctttgggattgaacttgggattctcagcctggcattcaggaccttggacctgatcctatcctacctttccaggttcatctctcagtacttcccacctgtggcctgtatcacagccatcccaaacaactgtgcccagaatccatcaagctgtctcattccttcatgccacatgtgtatatgtggctggctttgcccttcccacccccatcgccatctgcctggccaactcagaacttccagattcagttcaaatgttgctctttctccatgaagtcccaggcagaaacaaccaccctatctttcagatttatgaaaggtctctgttagaatttgtagtttcattccccttttattgctcatcaaatgtatttctgatcttggaattggatgaacttttatttatttatttttgagaccaagtcttgctgtgttgcccaggctggagtgcagtagcatgatcacggctcactgcagccttgaccacccaggctcaggcaatcctcccacctcagcatttccagtagctggaaccacagttactcaccaccacacccggctaatttttaaattttttgtagaaacgggggtcttgctttgttacccaggctagtctcgaactcctgggctcaagtgatcctcctgctttggcctcccaaagtgctgggattacaggcatgagccaccatgcccagccagtgaatttcttttcttttctttttcttttttttttttttttgagacaggttcttgctctgtcacccatgctggagtgcagtggcacaatcacagctcactgcagcctcagcctcctgggctcaagcaatcctcccacctcagcctcccaagtagctgggaccacaggcatgtgccaccatgcctgggtaatttttgtattttttgtagagatgggtttttgccatgttgcccaagccggtctcaaactcctgagctcaagcaatctgcccacctcggcctctcaaagtgctgggattacaggcaccagccaccacacagccgaatttcttaaataagaccctaaaagcacttatgctgggattgagataaatccaggcagacagctaccctaaatggtatgtggaagcctccatggtggagaggaaagatgtggagacagataattacaaagctatgggttatctgctgagatggttattccactgtgtattatggttcctttgaggccagcatttgtggctcattcatctctgtggcctctacccctctccctggcacctagcacattcctaatacaaaagaggtggcaataaatgtttgctgaataaaaa

SEQ ID NO: 3 - DNA, 1958 bp, Homo sapiens
  nbla24135
gaggcctggggtggggacgcgaggacaccagcgtagaagagcttacatcagaatcgagctttgtgggcgctccgggatttggccctttagcgcggatcctagacaacaggttttggacctcgagagctgcagaactgaggctactggtgccgccagcctgctggctccgcctctgcctcagtttcttcccctatggcccgcgtgccgctggggcggagtctcactctgtcacccaggctggagcacaatggcatgacctcagctcaccacaacttccgcctcccaggttcaagggattctcctgcctcagcctcccaagtagctgagattataggcagtgaaccccttgagcacggggcccgcgcctggcttgttctccgctgtctccagcacctaggacagggcctggcacgaagtaggtgcacagtgagtagtgaatgctggagtgaatagatgcaagagggctggtgtcttttagaaagcagcgctcagtggctgagaactcctgggttccctgctgggcaagggttaggcgtacatttgccagggtgttaaaggaggaacgcagggttcaaatcccagctccacttaacctcccccacactgcggcgacgccgcgctttttttccgacccaactgagccggaagtggaggcgcgggcttcccatgatgccccgcgagacctttattctaaccgcaaggagtagcggaggggaggtcgtgatggcggcgccggaggcggaggttctgtcctcagccgcagtccctgatttggagtggtatgagaagtccgaagaaactcacgcctcccagatagaactacttgagacaagctctacgcaggaacctctcaacgcttcggaggccttttgcccaagagactgcatggtaccagtggtgtttcctgggcctgtgagccaggaaggctgctgtcagtttacttgtgaacttctaaagcatatcatgtatcaacgccagcagctccctctgccctatgaacagcttaagcacttttaccgaaaaccttctccccaggcagaggagatgctgaagaagaaacctcgggccaccactgaggtgagcagcaggaaatgccaacaagccctggcagaactggagagtgtcctcagccacctggaggacttctttgcacggacactagtaccgcgagtgctgattctccttgggggcaatgccctaagccccaaggagttctatgaactcgacttgtctctgctggccccctacagcgtggaccagagcctgagcacagcagcttgtttgcgccgtctcttccgagccatattcatggctgatgcctttagcgagcttcaggctcctccactcatgggcaccgtcgtcatggcacagggacaccgcaactgtggagaagattggtttcgacccaagctcaactatcgagtgcccagccggggccataaactgactgtgaccctgtcatgtggcagaccttccatccgaaccacggcttgggaagactacatttggttccaggcaccagtgacatttaaaggcttccgcgagtgaatgagtgcttcttaatcctaaaaacacaatggctgaattatctttctccatgtggcgctgaatcacccatctggtttggagctagagttgcttcctggtgagagaggaagcaactctccttctggttgtctgcctcccctcagatttcctgataggctgatggcatgtggctgtgactgtgactgtaatcattgctgaacaacatctctttgaatcaaaggttgattttcccagagggtgctgggtcaggcatttctattaggagttggaaagcaaaaatgggtccatagacactctatggaggtgtccctttctgctctttgctgtgtcctttcagaatttttaccaggaacataatgtggatgtgacttatgaacttaaatataaaataaatagattcttattaaaaa

SEQ ID NO: 4 - DNA, 1436 bp, Homo sapiens
  nbla24350
agtccgggtggtttcttccgaccgaccgtcagcactcgacaaataactgagcagctgctggggccgggaacaccgcggggacaggccctcactgtgaggataatgaccataccgggtcctgggagacctcctgaactgcagcggcagggaaccccgacacccagtgagtctgagagcctcacagctgcccgcctggctgactcccatcaggtctgaagcaccctcccgacagtcatggtggctgtttttgtctttcccaggagaaatgaatggcactggcaacctgggcctcgtgcctgttttcctgaagccatgtgtacttggcttctggaccgtggcgcacctgaccccagaaggcggtgcacttactgtaaggctgatgggccttagagaacacctccccagcgcctacgcgcaatcaggaccgcggacgcctcatgtctgcctgggaggtctccaaagggccaaacactcccggactcggccctgcaggagtcatttgctgtagaccatcccccagtgccacataccactggagaaagctgagtccagaggagctcaaacttgaaaacacaatctctctggagggtcaaggcctggcagggcagcctgaatggaatccaacgttacctgtgactaagagccaactgggagtgagacaagggtcctctggtctccctggatgacgggagatgcgcgcctcatcgtgtgatgtcaagaaccactgctgggcctaccctgagcagggagcagggagcggcactgtcatgcttgttgctggagccagcaaaggatgaggctatgcctcagcttccgctccgctccactcagtgctggcctcatcgccccacccagggggcagaactctccccaggagcccacggtgctgggcagaggcagaggccacttgggcggtcagcccagagctgggtgggcccggccagcgggactttgcggcctccccaccctccggatctcctgatcaggcgtaacccaacccgggcagctccttcggctccaccatccagagacaagctgacttccgataatgactttattttaacatatttaattacagacataaaatagctggggaggggggtgagccccagcctagccccaccatggggctataggaggggaggcgcaggcggggcccccctgctgaccctctctctgggggtcttcctatggcggggccctattgcttgagtgggggaggagccatgcaaatgaggggggcagggcagccactcggccccaccccaccccgaggacggcctccccacagaatgcccaggctgtgcccccagccccagctgctccacctccttcttctctgtccagggagcagaccctctggccagcccctgactctgcccctaccccctctgcaaacctaaaggggaataaatacaaactttacaaagtaaaaa

SEQ ID NO: 5 - DNA, 3062 bp, Homo sapiens
  nbla23701
gagaggcgggcgcctaccagccggcagctccggagctgcccgcgccatgtccgcgcacaatcggggcaccgagctcggtaaggggcccgcggggctccccatcccctctccctcgcgttcagcgccgccgggactagcgcggggcctgctgccgcccagtgccctggctgtgggtccccgaggggttttcgctggggcgggaagcagtggcgtctggtcagccctcaccccaagtaaaggccgaacccggcacgttcgcgccgcttgtctttgcacctaagcttttactctggtatgcggaaggagtaggaaagggttagattattatcttcctgccttttcgttcactctagctcgctggttggaaaacccaacaacccaaaaaacaaaacccaaaacaaacaacccccaagcaggtaaaaacagataaaaaccttctttctcctccttttaatagaatacttgtgtaatttaatgcagtatttccgtagataattttaaccgtaaccttgaagtggccgtgctcgtggaaaagttgtcagccgtctgtgctcaaaatgtaacactgcagattcatgggattttagagttacaaagatttgttaaagtacctgtattatttcccagttttcatctttttttatattgttcaaatactggcaagaaaccttagttcagatttcttttttttttttttttattgatcattcttgggtgtttctcgcagagggggatttggcagggtcataggacagtagtggagggaaggtcagctgataaacaagtgaacaaaggtctctggttttcctaggcagaggaccctgcggccttccgcagtgtttgtgtccctgggtacttaagattagggagtggtgatgactcttaacgagcatgctgccttcaagcatctgtttaacaaagcacatcttgcaccgcccttaatccatttaaccctgagtggacacagcacatgtttcagagagcacagggttggggataaggtcacagatcaacaggatcccaaggcagaagagaatttttcttcagatttcttaacatgtgaaaaatttataattcaaacagcaaaaccatgatcaagagaaggtttaagcgtctcgtttaagtattatagcttggatatctgtgtatccaggatctttaacttcttacctgtgtgacttcggacaaattaataactttgcgcttaagtttcttcatctgtaaaatggttattttagtggtagttaccttataaggccgttaggagattaaataggatacatgtaaagtagtttggtatattgtggacacctagtaagtcttcagtatagatagtattagtatatggagttatggttttaggggctaattttgagaaaattggctgtaaattatatgtaacacatacaggtaggtccttttcgccctccttaaaagtgactggtacttaaacagtctgcacttccaagaggtgttctggattttttgtcgaatggtaagagagtaaatctatcattttaaagacagttgatttactaacctggttgattttgttttagtcactgtcctctagctgattatgttttaaactctagtcctatctctggaacgtggtctttagtaataacggcattatttcttagattggaatatccttgaaggtggtggatatggggcaggtttggggtggtgtcttacctgggtattcccaggaatatgaccatgtgactatgcatacatcaaggatgtgccctaaatttcccaaaacttagacattttaaatttttctttcaaaaaacataattgaaccatttttaaatttatttatttgcagtaattagaatcaatcacttccattcatttgttgaaaagtaatagacataaataattgccaggtagaacaatagtaaatgtggtttttatgcagctatcgaaatgatcatagctttgtatttattatcttatttgttaaaatcagatttttttccttcacgggtattaatccttaatccaaacaggtttaaactgaaatgctaaaataagttatttgaattaggtactagggaaaaaaatctttcagtattaatttatgcagtatattaactgatgatttttaaaatagttttctaattgaaagtctttttaataaacatcgtaactaatttctaaaataaattaacatttttgcttcccttttcttattacaaaaggaattcatggttattgtaaaaattctagaaaatacagttagcacaaaaatgttgtaatattattactagtccaatcactgttatttatgatttggtgtatgtacttctagttcatggacttaaaaaaacattgagttcctttgagactaaacctgaccctcatgattaaaaagtctttaaggaaaacattggcatttggatgtatgaaagatgttttccaaatagggaatgtaccctctagctttcatattagaggatggggcccagcattctgagttttaacaaatcctgtgggtagtactgaagcatacccaagtttgagaaccaatggcttaatgatctccaaggtactatcaagttttgtacctagactattatgccctatatagtctattaaaatgtacagatattcttctattttattagatgccacttaactattgcctaaaatgcaggtgtcacgtgggtagtgatctttcttttgttcactgatgtgtcccaagtacctagaatagtgtttggtacacagaaggccctcaaaaatgtcttgaggctgggcatggtggctcatgcctatagtcctggcactttgggaggctcaaggcagccggatcacttgagatcagaagttggagaccagcctggccaacatggcaaaaccctatctctgctaaaaatacaaaaattagctgggcatagtggcgcatgcctgtagtcccagctacttgggaggctgaggtacgagaatcgcttgaacccagagagtggaggttgcagtgagctggaattgtgccactgcactccattgggcaacagactggagacagactgtgtctcaaaaaaagataaaaa

SEQ ID NO: 6 - DNA, 2900 bp, Homo sapiens
  nbla23890
agcgccgaggcggtaccttcagcctgcaatgagaggaacccgggagagcccccgggagccagcgaagagcttggctgctgcgtccagggctgctgctgccgccgcggctgcttgaaactcctcaaagttgagagccggctagagggtgccgcccgccgggagccggagggaaaggaagtcggaaggtgcaagagtgacagacacggacagacggacgcgcagaccttcggaaggcactgcgtaggcagcctccccggagcccacgaggctccccagcaccgttcactggtgggaggctgagccggtggaaaagacaccgggaagagactcagaggcgaccataatgtcgttacgtgtacacactctgcccaccctgcttggagccgtcgtcagaccgggctgcagggagctgctgtgtttgctgatgatcacagtgactgtgggccctggtgcctctggggtgtgccccaccgcttgcatctgtgccactgacatcgtcagctgcaccaacaaaaacctgtccaaggtgcctgggaaccttttcagactgattaagagactggacctgagttataacagaattgggcttctggattctgagtggattccagtatcgtttgcaaagctgaacaccctaattcttcgtcataacaacatcaccagcatttccacgggcagtttttccacaactccaaatttgaagtgtcttgacttatcgtccaataagctgaagacggtgagaaatgctgtattccaagagttgaaggttctggaagtgcttctgctttacaacaatcacatatcctatctcgatccttcagcgtttggagggctctcccagttgcagaaactctacttaagtggaaattttctcacacagtttccgatggatttgtatgttggaaggttcaagctggcagaactgatgtttttagatgtttcttataaccgaattccttccatgccaatgcaccacataaatttagtgccaggaaaacagctgagaggcatctaccttcatggaaacccatttgtctgtgactgttccctgtactccttgctggtcttttggtatcgtaggcactttagctcagtgatggattttaagaacgattacacctgtcgcctgtggtctgactccaggcactcgcgtcaggtacttctgctccaggatagctttatgaattgctctgacagcatcatcaatggttcctttcgtgcgcttggctttattcatgaggctcaggtcggggaaagactgatggtccactgtgacagcaagacaggtaatgcaaatacggatttcatctgggtgggtccagataacagactgctagagccggataaagagatggaaaacttttacgtgtttcacaatggaagtctggttatagaaagccctcgttttgaggatgctggagtgtattcttgtatcgcaatgaataagcaacgcctgttaaatgaaactgtggacgtcacaataaatgtgagcaatttcactgtaagcagatcccatgctcatgaggcatttaacacagcttttaccactcttgctgcttgcgtggccagtatcgttttggtacttttgtacctctatctgactccatgcccctgcaagtgtaaaaccaagagacagaaaaatatgctacaccaaagcaatgcccattcatcgattctcagtcctggccccgctagtgatgcctccgctgatgaacggaaggcaggtgcaggtaaaagagtggtgtttttggaacccctgaaggatactgcagcagggcagaacgggaaagtcaggctctttcccagcgaggcagtgatagctgagggcatcctaaagtccacgagggggaaatctgactcagattcagtcaattcagtgttttctgacacaccttttgtggcgtccacttaatttgtgcctatatttgtatgatgtcataatttaatctgttcatatttaactttgtgtgtggtctgcaaaataaacagcaggacagaaattgtgttgttttgttctttgaaatacaaccaaattctcttaaaatgattggtaggaaatgaggtaaagtacttcagttcctcaatgtgccatagaaagatggggttgttttccaaagtttaagttctagatcacaatatcttagcttttagcactattggtaatttcagagtaggcccaaaggtgatatgactcccattgtccctttatttaggatattgaaagaaaaaataaactttatgtattagtgtcctttaaaaatagactttgctaacttactagtaccagagttattttaaagaaaaacactagtgtccaatttcatttttaaaagatgtagaaagaagaatcaagcatcaattaattataaagcctaaagcaaagttagatttgggggttattcagccaaaattaccgttttagaccagaatgaatagactacactgataaaatgtactggataatgccacatcctatatggtgttatagaaatagtgcaaggaaagtacatttgtttgcctgtcttttcattttgtacattcttcccattctgtattcttgtacaaaagatctcattgaaaatttaaagtcatcataatttgttgccataaatatgtaagtgtcaataccaaaatgtctgagtaacttcttaaatccctgttctagcaaactaatattggttcatgtgcttgtgtatatgtaaatcttaaattatgtgaactattaaatagaccctactgtactgtgctttggacatttgaattaatgtaaatatatgtaatctgtgacttgatattttgttttatttggctatttaaaaacataaatctaaaatgtcttatgttatcagattatgctattttgtataaagcaccactgatagcaaatctctctccaaaaa

SEQ ID NO: 7 - DNA, 2708 bp, Homo sapiens
  nbla21650
atccaaaagattatcatttcaacatgcaatcctattttaaaaataactagtgaggtacctgacaaaaaaaaatcccttttcatactaagtccagaagatctttgtgtattttatactcataggacatctgagtttggatgttacctttttattggaaatatgggatctgtacttagatttcactgaatttacattgaaaaggtaggttcacatacccaagttgtctcacacgttcctaaatgttttctggtaactggatggagtatcagtttttatatttatctttgcattagctaaaaaacaaattaatagttcaggtcctcagccgcacacaggcagttttctccacggtccaaattgttgcccgaattcacccagaccccgctgtcctccgctttttcatgcagacattcaaacaactgcctcccttcctcctggcacccctcctggcacccccatcccatcgccagcagcctccaaaccagtttccctcctgtcctcatctcagccacccatgactcacacacacatctgtctcccctggcccacttttcacctggtcctcataatctatgcataaacattaacgtaccacaggtcaatctgcatactgattacttctgctctggtcaaattcttgctttcaggatcaggaggctttctccccacaccaaactgggcctgaggaaatagtgtcttgtcttcctgtcacccctcccgtagttgcatgtctaatgagacaaggggtgtctcaggtgaagcaggacagggaggatgccagcacttgggtggtagaggtttgaggagtgcctgttgggggatgtgttggggaaggaggacttttcacatatggctcattgtgtcgggatgatttcgttgttaaataagcacctacaggatgatttcacattccatacttctaagtttttataatttaaattctttccgccaggctgggtttttttttttttccaaactttaaatctgtggctagaattggtttgatttacctaatcctgcccctgagatttagccccatccctgagagccccctcagagccacccacagccaggacacctctgctggcctccccttccccagccttccaacttgtggcaggcccccggctctggcctccccctatatgggaatgagccagctgcaccgctgctgacagtggctgggataatcctccctgagctgttccaaggattagtcctgctgccctgtgcccagctcccacacaacggggtttcggggctgtggaccctgtgccaggaaaggaagggcgcagctcctgcaatgcggagcagccagggcagtgggcaccaggctttagcctccctttctcaccctacagagggcaggcccttcagctccattctcctccaaggctgcagagggggcaggaattgggggtgacaggagagctgtaaggtctccagtgggtcattctgggcccagagatgggtgctgaagctcccacgcctgcctgtgaaaatggagtcctctctcacctgggagagccaggtgctgccccgagaaggatgcatttatggcttcatgaagtctttcctgacccccgatgctgctgactataggtaagtctgagcaaatctgggggagcctcatcttggcatgagaaagagatggcttcttctaagcccactggccgtgatcccaggattataacacattctggctcaagtccagactatttgtagaacacaggagatcctccatgagaggtagtataatatagaggatatgtgtgcttactaagaggctgcctgtctgaccttggacaagttctttttatttatttatttattttttatagagacaaagtctcactatgttgctcaggctggtcttgaactcctggcctcaagcgatcctcccaccttagcctcccaaagagttgggattatagacatgagccactgcacctggccgaccttgggcaagttcttaaacccttcaaagcctcatttttctccaatcataaaagggaaagatggtaatattttcccctccaaattcttgtaagtattaaacattgtatatgtattttgaacacgattaagctctaaacacttgttaggaagcaggagtagcatttgaaacaaacagctcttttcccacaggtcggatgccctcacagaattgagattatgtacgtaaaacaccaggtgcctaacccggcacagagcaggagggctaagcgtgacatccagcacgtggtcagtggaatccagtattcctacccacctctctagtctcccctccacccctctccctttcagaggcaccaagctgcttgtggtcttgtctattcccactccctgcctgactgaacattttctccacctcctgatcatcagcagcagaaactggctgctcttcctcctgggtagacagccagactgtatttcccagctgcccctgcagtgagatgtggccatcggagccagcattggccaatggactctgcatgggagtgacgcatgctgcctccaggcttgtccctaaaacctcccacgtgtcctccgcctgctcttcccacttccaaggagcacggcaattgtggaagacccagattagtgatggcagaaccatagatgggaggaacctgggtccctgacttaaagtatcatggatttggatgttcccttagtgagaaataaacttccattgtgtttaaaaa

SEQ ID NO: 8 - DNA, 2312 bp, Homo sapiens
  nbla22094
gctttttcaatttattgatatggtttaaatgctcccacagaattgtgtgagagagcaatatgtcattgattgaaaagtgggaaacaaactggtagtaatggtcaggatttccccttttcagaactttggtgcatttgaagtgcctgacaatgtagtccagcttccctcctgttttacctagagggctggagatatgagggcccaaaggggccacaactgttatcttaagtggactgaaaggaagacgaaattaaaactagcttctactccacttgtaggaaatgtgcttttaatctttggtgtagcccagccttctaggaacaaaagtatcctatgttggcaactgcagtaacaaaacagttatggagagtatggaggagagccagtaactcctaaaggtcttgttcctttgacttttcttctcaaacaaacatgagatattcatgaattgcaatggcaaacgttttttaggttcgccaatatgaaaatgtaaagcagttttaagatgattaatattaaaataggccaagtgcggtggctcacaactgtaattccagcactttgagagcccaaagtgggaggatcacttggcctccgaagttcaagaccaacctgggcaacacagatgtcatctctagaaaaaaaaaaaatttttttttttaattggccgggcatggtggcatgtgcctgtggtcctagctactcgggaggcttaaagccgggaggcagaggttgccgtgggccgggatcgcgccactgcactacagcctgaccgacaaagcaagactcagtctcaaaaaaaaaaaaaccaaccaaccattcactaagtgcatgtaagcaaatctaccctggttgtcccaaattgggattcaaccactttagaagtcttgttagacattttttcagttgatacataatagttgtatgtacttaccgagcatgtgatattgatatgtgcatacaatatataatgatcacatcagaataactggaatatccatcacctcaaacaatgatcatttctaaaagaacattccaaagctgctcttttagctgttttgaaatatacaataaattattaattgttggaaaacttttgaaagttatctttaagctgcttttttggacaagaggtatataattgcaatacagatggatattaacttccactgtatatttcattaaagctggtaaaatttttttaaaggatctaaaattttgccatgtaaggaacttaagcatctttatgtttaattgcaaaatttttatattcccaatataaaaatttctcttcaagtatttcctgcattgccattttttagcatgtttggctattctgctatgtaacctacctagtgatactcgctggagacagtccgtctacaggcatgtctgataggcacaagttctttattcacacaaaactaacatatagagtagaatttatgggatgatgatgtcgtttgggatagaggtatggaaaaaactgcattatgtccaaaactttactacagtggagccagtcaacatgtgtacaacttaacacctaacaaaaatggctccaaaaagtatacatagcactatttctgttcatcccatctgaatggaaaattttacttagctggtaattctcaaaatgttttgttgactcagggaaggggaaacatattttacatgcacagaatgcttcagaacttttctgctcggctaccaatctgccatgtaggttgataatcaaagtcctaaagtacagtttagttctttgggcctacagggacaccttgttgactaactggcttcagccaatttttttcagttcacacacaagatcaatttctttgtcagcaaataccttttagaaaaagtacactacaaacacacttggaaaacattttattaagtactgtataaacagctatttagataataattgcatagaactataccaaggtaattgtgtctttaaggaacaactaccaagtgaacaagatgagcaaagtcctctattatacaagatttccttcggtggaacattatggtgacaaagcagcgtaatgagctcttaagcagattgatttttatcaaactggacatatcagaattccttatgtataagagaaatatgcacatgctcctttcaagaaaagagtgataacccaccatggaattacctccagtttaaacatgtactcttgactgccaaaaatatcgagatatgttaagcaagataaagcagcagaacacgctttaaaatatgttgatctctttctgtaatctacatgttaatattaaatgttcttatccttgaaaaa

SEQ ID NO: 9 - DNA, 2110 bp, Homo sapiens
  nbla22739
tagctttatcacttttctcattccatatgattgcttctttagttaactagcccttgaaaacttcattttaggacttatttgttttaatgtacagatgtgggaaaaccacacaaattccgcagtttattctggatgattctctgagtggaccacctgagaaggtagccaacatcatctgtacccaaccccgacgaatctctgcaatctctgttgctgaacgcgttgctaaagaaagagcagagagggtgggtctgaccgtgggataccagattcggttagaaagtgtcaaggtttgtatgctctgcttatttcctggtaacagaaatttatggtttttaggtataaaaagttttgggggttaggagattcatgggcaatttgggatatatactttcaggttatttttaaattaatgattacctttggtaatcatttatttaaatatttagaaatatttagaaatattttggtataagaactcttatggccaggcgcggtggctcacacctgtaatcccagcactttgagaggccaaggcaggtggatcacctgaggtcgggagttcgagaccagcctgaccaacatggagaaaccccatctctactaaaaatacaaaaattagccgagtgtggtggcacacgcctgtaatcccagctactcgggagtctgaggcaggagaatcccttgaacctgggagacggaagttgcaatgagccgagattgcgccattgcactccagcctgggcaaaaagaggaaaattctgtctcaaaaaaaaaaaaaacaaaaaaactcttatttggttgtactaaatttcctctgtaaagctttttattttttattggcagaagtcatctagtaaagactgttttgctcttgaacttgggacataatccatttaaccaaataaggagcagacagattgagaactgttttcattattcactgttttttaatgctttttatgaaaatcttaacattgtgatatgaagtagaaaggcttttattactgtccctggcaagaaactatgtttagtatggtttcctattaaatggaactgctggtgtttccaatattttttatcactatccattcaaaatggctttccagtaatgtttcctttttttgaaaattttattaatgatttatattgccctttcatgtgtaagtcctcagccaccagactgttatactgcaccacgggagtgctgctgagaaggctagaaggagatacagctctacaaggagtttcccatatcattgttgatgaagttcatgagaggacagaagaaaggtaaaacaaagactttcccagggaacacacactcacctgaattgaaggcatggcagaaaaaattgttttctagttccaattcagtttcatgcagctagtaatggtaatttgccacaaggaaggcctatgttagagaagagcaactgctttcttgatctccagggtctgtaacactaaaaaggacagcacatgctcatcacttattagatggagtcatcctgttaggttagaaggtatacttcacaccatcctgggcattatgctaagttgaataccgtacttagtagaaataacagatgtcatgcatgctgtggctgaatgtatcttcttccttgtttatttggccattcagtcctgacattgattcatgtatttattgagcctgcattaaatgccaagtgatatattagttgctggggatacagtgatgaacaagcatgtatggctccccctcatctcttacagtccagtagaaaaaacaaataatgaacaagtaaacaagcaaatgattgtaaattggaataagcactatgaaggaataaacggcatgctgtgtttggagggagagacccatagatgctcaaagatcatatctctgtaagatgacaatttaaattcaaaactgaagtatggccgggcgcaatggctcacacccataatccctgcactttgggaggccaaggtgggaggatcgcttgagctcaggagttggagccccacctgggcaacatagtgagaccatgtttccacgaaaagtaaaaaaaacaaaacaaaacaaaaaatagccagtagtcattctactggggatacagaaaaa

SEQ ID NO: 10 - DNA, 2416 bp, Homo sapiens
  nbla23525
tcactatggcggttggaggaacggcagtgatcacacgtcggctgctgggaagatctggattctcgtttcaggtttcggggtgggggtggggagaaagggtcgatgatttccttttttcgtcgggtatagacgggattacctagtgccttcacaatcggtcagagctggattcagattcctgctcgccaacgcccagcttgggcaaggctcctgttctttctgtgtctcggtttccatgtttgtaaaatggtgataataatagtatctacctcagagacgtgtactgtataatagtgcgtataaggcacgtaatgtgaagcctggcccctgaagatattagctattgttatggagataaataatacgcgtaatagaatgagaaaaattataaattatataaattcgctaattgtagtgccctttctgccatcaacttctttcctagaataaattaaagataaaatagatataccaatttttaccaatgaaataatttgttatttgggaattgcctcaaaatagcagagattgtaattttcctatattgaaaagttaaataaaaggtgggggggggggagtgcaagaaagaaagagatggagaacgagagcgagctggagatgaaccacatgcgatgagtaggccttgtttggatcctgaatcgaacacaccaactgtaaaaatatgtttaagacgcatcgggaaaattgggacacggattcgatatttgatgttttttagggaattgatgtcagtttttttaggcgtcacagtagtattgtgattatgttttcaaattgtccttttttgtagagacatacgaaaatatttacggattaaataatgtctgggattggcttctaaatacattaatgactaggatttgcttcaaaataatctcagcggtagggggaaatggggaggggtatagatgaaacaaaattggccctaaattaataatatttttttgctgagtgataggcagtgggttgcgtatattaatctgctttccttggtatacgtttaaatttttctataataaaatacagaagtcagatattccggtgagcttgaaaaagtcgggggtgggggggagcagtgggtggggttatagatgaaacaagatggccttcagttggtaattgttgaaagctggatgatggattcgtgtaggtttataatactatttcttttttatttcatccatttgaaattatatttaaggaaagttaaaaaacaaatttgtcagaaattatacaaatgtacaataaattaaatttgaaaatgtggccacaagaaaggaaaaagaaacacttgtacattatttatcagctttggtgtcctttgtgtgtgatgaaattgcattggctgatgtagaagaaagccatatctcatatctttttattttatgttctttcttgtccttttgtttgaccttctaggtcaccatcagaaaagctaagtttgctgtatagtgaggatcaggagatctgatcctgattgcagaaccttccctgattacagaatcttgggtaagtgcctcccttctgtcctcagttctcaaacaggataataccacataaccttcctaactgtccaggaatattttgaaaattaataagctcctatctgggaaagtagtctaaattctgagaagggaagggtggagctaagtccattgatagttccagtatagaaagtgcataagcaacagagggctttgtaatcttacatcccttgataaaagatactacagtcaatctcctgtagtagttccacagttccatagattacatttttccttggagcatcctatatgcagcatagtttagtggttaagagcaaatacttcctgaatttaaatcctggctctgccacttaactatgtgatcttgggcaagatatttactcactttatacctaagttcctcgtatatgaaacagaggtgataataatagttcctacttcataggattgttgagaggattacatgtaaagtaccaggacagtgcatggcacatgtaagtatttgctttaataataattatggttctgttagtcctgataatctcatgttttatctacacatttacacctacttctaaaagcagtggatatatttctttttggaattgtgtaaaaaaaaaataataattaataccgttggtttctctcctcattttccagaagcagcagttaccactagaactgaattccgaaattatgacttctggcttgtcttaacaatctagaaaggtttcaaatatattgatcatatttatttatgagggaatttccaggagctataattttagctagcagttcaaaccaaatttataaataagcaaatcttttcactgaatattcagtctgctaacagcttttgtatcattcctcctttgtctcagacttaaaaa

SEQ ID NO: 11 - DNA, 1710 bp, Homo sapiens
  nbla20226
taatgcttgctagccagccctcacttcctactgtgcagcccacagaccattaccaggctatgacttgggtactggggacccctgatttaaacaagagaaatttattttctcacagttccataggccagaaatccgagatcaagtttctggtcaatttggtttcttgtgagggctctcctcctggcttgtagacagccaccttctctctgtgtcctcacgtggcctttcttcagtgcatgtgtgtggggagagaaagagagagagagagagagagtgagacaggttcctcttgttataaagtgaccaatgcaatttaattaggactccacctgtatgagctcagttaatcttaattacctcccacagaccccatctcccagtagtcacacaggggttagggcttcaatgtatgaatttggggggaacacagttcagtccatagcacttcattttatttttttcctacatttaatcaccttattgaattttctgaatagcagttatcactgctggatatttttcttactcgtgtatttatctgtttagttttcactatcatgatttatctccccagagtagaatgcaaactccattagaccactattgtttcttgttcatcatgatactcccagagcctagaacagtgcctagcacaaacaggacaccagaaaacatttgcttatgaagagaagagcttatattctgtgagagcttcaccagagcacattttctgaacacttcctaataacgtgacttctcatcagtacaagaaaaaccaccccctggtgtttcagaacagttgttgagagggaaaacagaagtggagtatttttgtcttcagctgttcatgcatattcttactttctctctagatgtctattactgcatacacagagaataaagtgtgccaatctgacttcctaactctaattgcaatcaggttgaaatgatgagtgattcttggtccccgttcttcagaggaggtacatatggcaggttgatcaatgtttaaatggaaacgtgatctgttatatagtgagcccagcagtgaaactctcttgttagcacattcatttgtgtgtgtgtgggtcggtggggggcggattctaccttatatttttcccatactgtatttatcttctcattataaatatttctaaaataaaaatagaacaatatttctttgatttcttttgcatgattattgataagactggcattatcaaagaagaaagcacatcagtgttaacaagggagaatcggatttaaattatggcaaatttgagaagaaatgtgtaagttttagtagaaagagttagtaaaaaacatacagaaatacaaaaggattgacattattttcaccacaataatggagagtcagggtgttccatcttaggatcatggaattgtaattgaaaaaaaacatgtaaacaaaatggtcattagaggtagtgtccttagtgtgctctatattgggaggtctgaaggaggaatgagaatgaggtttgcgcctcatacaaaatatgagatcatagagggagaatttgagttatttataaaagttaattttaatctctgtgctagatggtggctctgaaaaatgcagacacattgcttctattctggttaaactaagataggtaataactgttacacttatacatcatgtttctcattcgtcattgttgcttggggaaaaaaaagcaaaaa

SEQ ID NO: 12 - DNA, 1714 bp, Homo sapiens
  nbla22182
aattaacagtatatagttccaccattcttttcacactgaatatcagtataactgactgccatccatccattatatttatactgtttaaaatgtaacatgtgatagagacttttttaaatgcagtgatcatagtttttacccatcttcatgaagccaaccttggaagcaggacatggatagacagttactatggatctttttataggggatattattttttctagattatgtgtaacaaatcattccataaatgagttcataccttgttcaaaaatagcacaatattttttttatgttagatttacattataacagacaaagtgaagcaaaagattttggaattaagaaaagtaaattgagtaacagttccactcaatgcctatcaaatattacctttttcatataagattcagaatctttcaccaccatgtgtccaaatagtgtctttaatttaaaactttaatagactgagttctacaaaggaaaaaaccctttaatataaaagtaaaattaaacctcaatttgctttcatcctttaacaggttcactaccagtaacaggaattagtttccctgtagaaacatcttatatataatgacttatgaaggaaactcactagaaagttataataacagcatcccatttcttccaaggactgtgttttaatgtaaatgttctctgctattattaaataggcccctatttatggatcagacaagatcattctgtatatttgttctctttcatattgaaatgtttttgattggggaggagggagatttacctaatgctgtgtatatataatattatttgaacaagaagaaaacacacaaaaatgatagtatcattctagtttggaagtatcactctttaaatgaaaacagggtatttattgtaatgtaaatcatgctttatgcaaagataatgtaccaaacccatgagcagaaatcccaccaggcctcacatggacctaaactgggagccagaaggctgttaggaacccatgagcattcttttcccatttcttgccgttgattctgtctttgcatggctgcttttttctttctcggcagctagctctctcccttgctctattacccagaccatgtggcctatggaaaatggcagccaatggcatccaagttcacctgtcacagttccacccacactgcatatttctgtctttctcagtcccactcccaaattcccaaagaagagatttcacttacccagtttggtccatcccaatacagccagaaggcaaggccatgtatgtataaatttagtcaccaaaaatgcatttctgtgggcaactaagaagggaagtggttattgtgagcttcgtagacatcaccaaaggtgtctgcttttgtctggatcatcaagaacaaaggatttgaagtaccattttttaaaatttagattttgtgccggcatgctggctcacacctgtaatcccagcactttgggaggctgaggtgggcggatcacctgaggtcgggagttcaagaccagcctgaccaacatggagaaaccctgtctctactaaaaatacaaaatcagccaggcttggtggtgcatgcatgtaatcccagctactcaggaggctgaggcaggagaatctcttgaacccaggaggtggaggttggggtgagctgagatcgctccattgcactccagcctgggcaacgagagcaaaactacatctcaaaaa

SEQ ID NO: 13 - DNA, 1931 bp, Homo sapiens
  nbla23256
cttaaatgtcagcatgtgttcatttttaacaggggtcgattttctaatccagcccattgtatttaaatgtgaaatagatatttttagatagcttcatctttggcatctttagcaaatgaactagctacaggagtataacttttgatgatattttgctatctgaggtttaagcgtttaattagattaaaattcacccttcaaatggagaactcagaataagtaaaatgatcagagatgactttgtagcttcccacctctaataatttattccactgttggttatagtaatgatattgggtagtggtttgggggcaggagattactttttaccaggttatcatttcagtatgtgttctgaagctgatgtcttctgataccataatttttacatataaatgagtaaagaagaaatgtaatcagaactgtgtttgaatgcatatctttttagttttgcaaaatagcatggatgttgtaagagaactggaaatttagggaagtttttaggaattctgaaatccttctaggtgcctctcagctccccattggtttctctatgtagccaggtaaagccatattttgtgtatgacatcagaaattgcttgtcattttgaaatttatgtctacatttgtcttcccaggggctcatatattttaaaggtatacatttttatttttagaatcaagtattgatttttttgtgaataaattactataatgatgccaattaattgaaaatcatttctactattataggatgagtgaaacttacagatgaatttaaagtttcattctagtaattttttatttaaaaaggattagagattttataatctgtcctacagttatcatttttgaacccaatcctttgtgtattaaagaatattatttaaaattccatttttgaaaagctcatgtcattgctaaaggttttgagattctacaggaagaccttgtagacctttttgtcaccctttcgaaattgaccagtattctttctaattgaagcttttaccttttaagtaattttgacaacaatatttgttctggctgttactatacaatattgaataaattatagtaggagggtgatctaagattatttctttctgaaataatgatagcttagaaacttgttaaacagagccttgggaatgtatgggaacttgaagtatatgcatttggaaaacatttaatgaacttttttttttaatgtagatattaaaaattattttttctaaaattaatgttatactaaaatcatagtttgaattgctgacatattaattgtggattaaataatctatatcttacagactgaatcatattcatgttgttgatgtcctttagaacagagaatgggtaatgtgtagattaactatagagacattaccagtgtacataaaagctattaaaaatcttaatattgtaatttagcactgtattccctctacctagttatttttcctcttcagctttcagccattttctgtatactttagtttttagtttttggcatcccctctggtttgaaacctatctctctacctttctaacattttctatttagtttaaatatgtctttatgcagttatacaataactctttgcccttgaggactgaatggtttcctttcctatagaagagttgttttcaagctttttttctcttgtctccacattcatataagcagtctgctctgatcagtagaatttctcggatagaggtgatcacttgaagaatgagggagggagggtgtagtttttaataaaaactctctagaggttcttgtgtcccctccactgagaatcacacttgagagcccatccttcctataagatttatatctgacctccttgacccgtcactctgctaaacagaaacgttctttcatgttttgaatgtgggaaggacaagcaacttgtagacaaaaa

SEQ ID NO: 14 - DNA, 2064 bp, Homo sapiens
  nbla21297
acattgatggaaatgtatggaaagcatacagttggaccgagaaactaattctcagagaaaataacttgactgaattacacaaggattcatttgaaggcctgctatccctccagtatttagatttatcctgcaataaaatacagtctattgaaagacatacatttgaaccactaccatttttgaagtttataaatcttagttgcaatgtaattacagaactcagctttggaacatttcaggcctggcacggaatgcagtttttacataagttaattctcaatcacaatcctctgacaactgttgaagatccgtatctctttaaattgccagcattaaaatatctagacatgggaacaacgctagtcccacttacaacacttaagaacattctcatgatgactgttgaactggaaaaactctgaagaagcatcggtagggaatccagaaggagcgttcatgaaggtgttacaagcccggaagaactacacaagcactgagctgattgttgagccagaggagccctcagacagcagtggcatcaacttgtcaggctttgggagtgagcagctagacaccaatgacgagagtgattttatcagtacactaagttacatcttgccttatttctcagcggtaaacctagatgtgaaatcactgttactaccgttaattaaactgccaaccacaggtgagagacagatggaaagacttaacccacgctatttccattttagaaagtgcaaaggctagagttacaaatacgaagacgtctaaaccaatcgtacatgccagaaaaaaataccgctttcacaaaactcgctcccacgtgacccacagaacacccaaagtcaaaaagagtccaaaggtcagaaagaaaagttatctgagtagactgatgctcgcaaacaggcttccattctctgcagcgaagagcctcataaattccccttcacaaggggctttttcatccttaggagacctgagtcctcaagaaaacccttttctggaagtatctgctccttcagaacattttatagaaaagaataatacaaaacacacaactgcaagaaatgcctttgaagaaaatgattttatggaaaacactaacatgccagaaggaaccatctctgaaaacacaaactacaatcatcctcctgaggcagattccgctgggactgcattcaacttagggccaactgttaaacaaactgagacaaaatgggaatacaacaacgtgggcactgacctgtcccccgagcccaaaagcttcaattacccattgctctcgtccccaggtgatcagtttgaaattcagctaacccagcagctacagtcccttatccccaacaacaatgtgagaaggctcattgctcatgttatccggaccttgaagatggactgctctggggcccatgtgcaagtgacctgtgccaagctcatctccaggacaggccacctgatgaagcttctcagtgggcagcaggaagtaaaggcatccgagatagaatgggatacggaccaatggaagattgagaactacattaatgagagcacagaagcccagagtgaacagaaagagaagtcgcttgagctcaaaaaagaagttccaggatatggctatactgacaaactcatcttggcattaattgttactggaatactaacgattttgattatacttttctgcctcattgtgatatgttgtcaccgaaggtcattacaagaagatgaagaaggattctcaaggggcattttcagatttctgccacggaggggatgctcttcgcgaagggagagtcaggatggactttcctcatttggacagccgctctggtttaaagatatgtacaaacctctcagtgccacaagaataaataatcatgcatggaagctgcacaagaagtcatctaatgaggacaagatcctcaacagggaccctggggacagcgaagccccaacggaggaggaggagagtgaagccctgccataggaggagaacacagcccacctcaggcctcctgcaaaaatacatagaataaacaacaacagttactaaatgaaaaa

SEQ ID NO: 15 - DNA, 1650 bp, Homo sapiens
  nbla20787
atttactaagagtaattgggtttaggatgttggaaatttttagcttgggggaaaaaacattcttatgaaggagataggttctcttctgagtttgtcataatatagattggtgtctttggaaaatggccacaattttaagaattcaattatgcatataaaatgataattattggaattccacagtaacagatttaaacagtcttaaattgtttatctcctttactgtaatgtattgaaatttttagagaaattttagttgttaacattttattaagtgccagtgtcagaatataacaaattatagtttcttatgaatgacaggcctacagttattattctggattatttgatggaggacaaacttacctgtatttgttagtcaagctgtgaaaataaggtggattacaaaagatgtgaaaaaaattttagtctgtagactcagtaattttctataatttactgttaatctcatttgaacatggattaggtacaatttataaattaattcaagtcagggtctttaggtatcaggtgccagagagatatttaacagatttccctacctaaatttatgtatatgtactgtctaaaacaatacttttttaaaaaaaaggaacagttgggagaaaataaatataatgaaaaattcccagaggctagcacttggattctaacacgtatgctattgtattatccattagttctgtaatatttaattttagattcttttatttttttaattggcaaagcacaaggtgctgtataacagtgtcatttagagttttatagaaagcttcaacctgagttctgcgttataaagcctggagaaagctaagcttagaacataacttgctgaagtataattatctttttgtagcaggaatttatgtgccagaggtgagagtctttctggtactgattttttgagaccaaggataaaaggatcgttttgtaagacatgccatggcaatggctggttgggggacagtttccgcccaagcttggcctattttatttttcctcatacctactttcaaagtcatttaggtatttgaagccttatttcccacgtagtaacactttctggcttttgcagtttctttttttgtttggttttgttttttgcatggaatggggatcaaacaacccgaagaagaacacattttgatcaagcaaaatgtttgcttcaaatttcagaagtttattttacagaaattaaattaagtagtttgacatccttttctctgtttcacacatatattaggttggtgcataagtaattgtggtttttgccatgacttttatggcaaaacctgcaattacttttgcaccaacttaatacatctatatacatatatatatacgcgcacacacttgttcagaagttatgttgtggccttggatttgtttttccccttggaaatggttcttaactctgggattttagaaggttagaatattttttcaagagaacagtggtactcaaaagaatgaaaggtggtccctacattttctgtattcatcacttaaaatttttaatttttccgagaactacaagtaacatttgaaccatgctgctgttgtaccttaaacaaaaactcagtgataaccagtatttagtctattaaaaatgctctttttgaagaaaaa

SEQ ID NO: 16 - DNA, 3050 bp, Homo sapiens
  nbla22284
gatgcggaagaaagagatgctcggaaagttctaataaaatggaaagatagcatccctagcatttttttcttgcttatagagatattccatgggatagcaaatcctgtgtcatggagatgaagtcaaaattcctgattccaaaaggttttgagaaaacaaagagggggaatgacgtaagaaagataggcatgagcatgtggtaactaggttagcacgtgtgcttcccagcccaggagcgaccaaatcctgtggtggcgtcaggtgtgcagtggagaggaatatagaggctgtatggcctccctcagtgagggcagggcaagagggatcactctgagagaacaaaaataggccccaagttgctaagcagtgattgggaaccttcctttccttggcggagatgcatgacattccctaccgatccccagacacagcctgtgggactcttaggagaaatggtgatttactgaataactgacccgttgccgagatgagtacaatgaagtggaggtgatgaactcaaatcgtcttccagggccaggcggctgaccggggtgagcgtagtggcccgctggggaccatggccgccctgacagccacacccacctggagctgacttggttctggctgttgctgccactgtgaaatctgtatctctctccatctctgctctactatccccggccttgccagacagtgttctttttcggaagaagtctagatttttgcatgaaaaaactcaatctttaaaggtcgactcagaacattttaaggaggcctccacttggtctgatgcagtcttgctaattaagaactaaaggccttctgaccttcttggtgctcatgctgtacggcatctgaatgtctcgaccgagtccgagccgtgcagctgtcctccacctgcgaaagtaatgagaatcctatcacgggacataaggataggtctaaacagggtccatgccaagaaaacagtggggtgctctcccaggcctctcccctgtccactaaccctggccttgccggctgccttccaggctctgggggaagagctcctgcattcttccctggccaccttggctccagggctccccagagagcctcttccctccccaagtacctgagaaagatgagagaggcacgtgctctgctgggaaggtccagtgagcggttcaagggcctggaatctccctacggccaagtctaagggttctgggattctgggctttgtgggctttgcttgcttgctgggaatgggctttccctgtcccgccctgccccacctcgcctctgtctctcagaagctccagaacccagcagtgacctgcaaaatgtggcctctgatgggggcttagggtgggagatggggagagcctacattgtcttttgctccttgaaaactttaatagctcctattttccagagaatggtgctttgtgagcaacatgcgagtaagagagaaataggaggaagggggagtaggggcggatgggagaagagtggctcgtttttacctctcactgccttgacattttgtgaacgtgaagcttaaactttctgggcttacaagacccaggggcacgtcagctccttagatgggctcagcctgacacataattcttaaacctttcctgtttaagaaacttctagaggctgtgtactctcaccaatcctcttcgagaatttgttcatgtgtatttccccattatatggatgaggctcaggataacagcatagtggctaccttctactgagttttgaggtgctaataagtatgtttgtctgaggctgcacatgtgggtggctctgtgtgtatgatccaagggacaaaatgacgatgtaggaaccagcaagaacggaatctgggctgatgcttcagtctccacctgggtgatggctagcctcccgccctccaccaccgcatcccacacgtgctgcgcactgtccccgtgtctcctggagaaccaaactggagaaaacctttctgagtatctctcatagtaccccttccttaagaagatgtggtttagagcatgtgtgcaatcctgcctctgtaattaggaaacggagcccgaggctttccattgttggttgaacccaggacagctggtgctattcacaggctgaagaactgggcagttcttacttgggtctgtcctaggatgtggaggaagttcaggactaacgctaggcagagagtatgactcggtttacccagcctaggggcctctggatgggaacactccattccaagatctcagcagagcagggcttcctggcttgaggctggaagcctttgggaagaggcccagctgggacattccctgggcacctgtcttccgctgaagggagcaaggtgccctctgggactgacagccatgaccctctgtgccatcctcaatccttgagccatatatcaagagtcctctagagccggatggtcctcaaaagtctgtccaaggaatgccaacgttcaccgggctctgagaaacgacgcaaatctctgagctggggaccacttggagaaccggcttagtaacagtcctgatcttcgcaagccagcttcttctgcatctgaggggctcctggcgcccagaggaggcagacagatgtcttctagctgagtttctaaccgcatgatgagactcagaccttccgctgcactagaaaatctgcaacagtgtccctgagtcacttctccttagtgggcagactcgtgttagatttgtggaacccagctctctgatttactccttttggaaaacccatggaatttcatgtataaggctttcatttgtattttaaggtttttctgtttgttttgagtatatacatggtgctcaatagcaacatcttagcagatgaagcagtttatgattccactccctcctgtatgacaggtagccactatactgaatcaaggtgctgaactcaaatcacaaaattctggcttaccgatacaacaaccaatacatctttgttctgtaatgtaaaatttgactccttacttttataacttattaaagttaaaatgtctgtgtttttgcaatcaaaaa

SEQ ID NO: 17 - DNA, 1733 bp, Homo sapiens
  nbla20123
gatacactgaaccccacgcctccaacgcaaggtgaaaggcatcacaaaataggcactgagtctgccccttggatgaagttagcattttttggcccgaggagcatctgctctggcactgaaacagcaataccgacacggagacgagagccatgcaaaaacactcagtttccgagccccagccaggacagtgcgagtgagtatcctgcttttctttgtggttagaatcaagtgtcatctaaaaataaccggttggtaggaagaagtcactgcatagtacaatgccaagaaacccggggatcagagagtcctccgataactgatgctgctcggggctcacgtttgtttggaaaactaaatctgcctccattttctgtgccggaaaaatcatcgcttcctgccaccacagaaaccttaccttttgcagaagctgggaaccggagtacttagcagcaatggattttatctccccaccaaaagccgaggcccagagcttcaccctacagggagaaggggcacaggaagatatgtaacacccgtgtcacagtcaacacgcacgcacacgcacacgcacacatgggactatggctgaaggagcagtgcgatgtaacatgttttaaaagaagaaaagatagaaaaagcggcttggtagaaactgccagcaccaaaactgcaaagcgcagcgcgggagggggcccgaggggggtcgcggagttaagaatgcgcaaagtctcccaggctctctaaaaagaccactgagtttcattcgaaccactgcccgaggactcgaccccccaaactgggcatcacctggcaaatagcagtcagaagaaatccacccatcccccccccaaaaaaagaagtggggcggcagtagagcaaagaggggggaaattcagcggcccatggaagttggattcggtaaccaggctccaaagttggtgccgtcacttgagtagagacggggtttcaccgcgttagccaggatggtctccatctcctgatcttgtgatccgcccgcctcggcctcccaaagtgctggaattacaggttgccctgaatctcaagtccagaaatccactagaggacctgttacggtggagagaagatcagtctccattaaggttggcgattgatcaggactatttatcaagaaaatcaaagacaaagacagatcctaggaggttctcatttaaccaaatggatagaaatcagatcactgttgaacatctagttggaactgactttgccgctctactcaaatggtgaaggcttccttcttccaacagactgtgtggcagcatgaattatgggcagggatctgtgactgctcaacttttctctggaggccctgctcaggggttcagctgtcctgttcctcagtgtcacatcttccacaaagccattcaccctttaaggattcactgagcactcatcctgtgtcaggtgctgagctgagcacctgggatttggaggacaggaagacacagtcccacaatcagaagagaagcctttccctagccttctctcagagcactcccccagaatcccttagcctatgatctgcatctcctgggcacctttcctttccaccttcttttacctttgtcttctacttccagtcctcttaccaccaggccatctgtcccttgagggctgcctcagaatctcccacagcatgtaacagaatgagtggcacacagcagaagctcaataaatatttatggaatgaaaaa

SEQ ID NO: 18 - DNA, 1498 bp, Homo sapiens
  nbla20382
atttcaaaattggtacacctgcagtactggagcttcaaagacaatgtctccactgtcaatgattaaacacttgtgcaagggagtcagatatgcctggtgctgataataccatggtgggttcagtgcagtcaggatggtgtgaatgaagaacttctagaacactaaggaatatgtaaaatatacccttcttctgaggaagtagagttgacatttgagcttgaaggaccaattggaataaggtttccgaaatatgttatgatgggtgggagtgtggaattgcaagcaaagcaaagagtgtgaccaaactggcaacgttggaaactgatcatagactgtttgaggaatggcaggtcccctgataaaagcagtgccaggagagagttgctaagcctggaaagagccttgcaagagtattcaaagaataagggctttgtttcacaggcagtgaggaactgtcgtcatccttaagctggacagtgatgtgttcagactgctgggtctattcttcctccgttctttccttcctttcttccctcttgatgatttccatgctttgtggaggttgtgttagagtaaaaataaaaaatacataaagcgtggcactgtcattctctgctagtggagatgcaaactgacacagctcttctggaggaaaaataggtgatacataacaagaccaacttttaactcaggatcttactttcagtaatttatgcaaaagatctacctgcaagaatatgaaaagacaagtggataagattatttactgtagtattcttggtaatagcaaaatattagatgttttgctattacctaaatattcacacctaagagaatggttgaataaatgatagtgcagctacacagtggagtacaatgcaactgtaaaatagagtgaggaaagttactgtgaattgattgctattgaataatgtccaggatatgctgtaaagtggaaaggcaaagtgcagaagggttactctgagatattccttacttaataaaataaaaaggatatatgaaaaataagcatgcacctgctaatttgtacaagagaaatactggaaagataaatcagaaaccagtgaaataaattacctataggaagtggatgaggaaggagtagaaggaagaggaccgaggtagtagagatgaggaagaacagcacttctcttatgccttagtttagcttggcctttaggaagtagagtagactgggcatggtggctcacgcctgtaatcccagcattttgagaagccaaggtgggcacatcacctgaggtcaggagttcaagaccagcctggccaacatggcaaaacgccatctctactaaaaatacaaaaattagctggttgtggtggcacgtgcctgtagttccagctacttggaggctgaggtaggagaatcacttgaacccgggaggtggaggttgcagtgagctgagattgtgccactgcactccagcctgggcaacagagagagactcccactcaaaaa

SEQ ID NO: 19 - DNA, 2256 bp, Homo sapiens
  nbla20660
ttaaaacttgtccgggcatggtggtagctcaggagttcaaggctacagtgaactatgattgtgccactgcaccccagcttgggtgacagacagagtgagaccctgtctctaagaaataaataaaaataaaaaataagaggagcttttggaattcagcttcttggaaggctgaggtgggaggatcacttgagcctgggcatggaggttgtagtgagccatgatcacgccactgcactccagcctgaatgacagagtgagaccctgtttccaaaaaaaaaaaaatgtgtgtgtgtgtgtgttgtgtgtatatatataatatatatatatatatacacacacacacaacacagacacaatttgtgtgtagctaggggcagatattgagatattgaagtgataagtaactggggatggggaagtactggtcacttaagagcatatagaaaaccgtcccagattgtcttttctaatctatttttggaggaggtttttatatatcccatgttttatattatttctcccaaaccggattagatatagtgaacaataaaataaatgcagtttccaaaaccttggtgttcagaaatgaagggaaccatgaggggagtgaaggggacttgccctttgctctgtgctgtatgcactgcccagggaacagccccaggacacttctatagtttctttctgagactcacaaggtgttagcaatgctctgagctcactcaattgacagatacgtttaaggttctcaaataaatttcaaacttctaaatttttccttttcattgtgtgcataatgtacagattaggaaaatgatcttctaattgagaagtatacttcaaagtttggaaataaaatcataaaaatgttttcctaaacatagcctttttcaggagtttttgtggatatggtcaaaggcaatagctctaattatctggggtcctcaggacaggaaatgagctcacactcatgctctcaaactgtgtcacagcatttttggaaatattttcatttctattcaagaggaggaacaaggccccaagtgttcaccctaattgttgaaaataaacataaacatgaaattcacaaaagaacaactataaatggctgcaaatatgtgaaactatgtttaacttcccagggagtcaaaaaatactaattaatacaagaatcatctttggcccaccacattatgattttgtctgaataagcctcttcaatgctggcaaatatgaggtaaaatggctgctccggctgctctttttggctggtcttaaggggcgcaaatagctccaccccatttggaaagcacttggcaatggctgctaagactttagtgtttttcatagcttctaacctgctaagaagtagatacttgttcccattttgctgctgtgcaaacagacttgtagaggtcaagtatctcgtacaaggttacattgatggtgattgatggcgccaagatttgaacttggttgtgagtccaaagtctaggtctcccattctacccatgtgattttacacacatgcctgatataattagctcctcctcctctccagagaagggcagctgacctttgtttcccagttcagaaatcctggtgtgagttatcagctggggttgagggtggatagatttgttccaactttacacattggacctgagaatgtactttcctgaataaacagttgtagaagcgagtgacagttgtggttgaagttgttcccccagtgcagtgccccagaggggttaatgacctttcgtgggctgtcccaggaacttcatccgaggaaaaggtgcttacctgctaacatttgacctgtttggaaattggggattgtttttcctcattgaaattggtgagggttggaagaatacgcaaacgaatgtttggtgtggaagaacgctggaggagtaaacttactatactcacaatttggattacaacatagtttggttaacccagctctggtgaaccaaatgtacaagtattatttccttatggttcatcttataaaatattttataaattggttgctttctttaagctctccacaaatgaaaaatcagtcccaaaaatctataaaagactatttcagcgttaattgaccattaaggaaatacatactaggctgcatgtggtagctcacgcctgtaatccccacactttgggaggctgaggcagacagatagcctgagctcaggagttcgagaccagcctgggtaacttggcaaaaccctgtctctacaaaaa

SEQ ID NO: 20 - DNA, 1411 bp, Homo sapiens
  nbla20666
ttaaaaattagccaggcatggtgactggtgtctatagccccacctgctcaggaggctgaggtgggaggaccacttgagcccaggagtgtgaggatgcagtgaatgccatgatcacaccatacactccagcctgggtgacagagtaaggccctgttaaaaaaaaaaaaaaaagtcctccttaaagacatgggctttctagacagggttcttctgctgaagcggctttccttctgccagaatctcaggaactcctggatctgcctttccagaaccagcttctctctccctgctctgccttcagactgccctctttctacctctccctctagaactacatctcttctggctgggtttatagcttggggctgggggaggcccagtgggactggctgagtggagccagccgtgtgacggaggcggccctcttccagttgggcactgccaccctctcgtggtccaagcagcacatgagcagaaccaggtgctcaacaccaacagccggtacctgcatgacaacatcgtggactatgcgcagaggctgtcagagaccctgccggagcagctctgtgtgttctatttcctgaattctgggtaagtggactgtggccagcccccgggaagagggtgagacggtaacaaagacagtcactcacatgggcccagtgtagtgtagctgactgagtgtggactcggagaggcagcccccactgcaccaggctcctgagattcccggctgtaggccctgatgctttctctgttggatccagtttccttgtctcttattgaaggatgttattacctcctttctaggatcattgctggagcttagtgaggtaatatgttcctttatttctgccttacggatacagccaaaatccctgcctgtgggttgctcagtaaggaaggaaaacatcaagtgattcttcaaagaaatacagaattgcaaggagggctctggaggaagtgtacagggtatcatgaggcctagaaaaagtgaggggacctgacctgggggttcagggaaaccttccctgaggaagggctgttaagctcagagctgactaggagataactagaagaggaggaaggaagggtgctgccactgcatcagaagtctcgtcaaggctgggcacgatggctcatgcctgtaatcccagcacttcgggagatcgaggtgggcggatcacctgaggtcgggagtttgagaccagcccggccaacagggcgaaaccccgtctctactaaaaatacacaaaatttagctgggcgtggtggtgggtgcctgtaatcccaactactcaggaggctggggcaggagaatcgcttgaaccgggaggcggaggttgcagtgagccaaaattgcaccactgcactgcagtctgcaggacagagagaggctctatctcaaaaa

SEQ ID NO: 21 - DNA, 1346 bp, Homo sapiens
  nbla21239
attactacattataaataaattcacagttgtataataaattgctaactgtctgtcataactgatagactttcagccccaccagggctggaaaaagtctgtcttctccactaagctatgtgtcttgcaagtatcagactgtcagcaaattgtgaaaataataagtgaattaaataatgcatttgatagtctagcaatagatctggctactcagcagcgtctctgacagcatccactttagaaataggcatatgtttttcccactttcgcactgtgtatcactgtgatgcaggtccttaaagcaattgaccagctaggtctcattcagaaaagagcagtcctgtcaggcgcccagcctatgtctgtatcaggtcctactacttggtacattgtctgtcctgagaagcagcatcatttggtccatgcttatgacctctgcccagaatctcttgaaaaggagaccacaggaagcaggcatcatgaaggagtcttcagaagaggcagtgtaccaggaaggcaccttgtctggaccccctgccgggtattcaaattttgctatacattagaatcacttgtcaaaaccccagtggccagatgaatcccaataagttttaaatcagaatttttggaagtcagacgcagacatcaatattttctaggattgccaggtgattccagcatgtagccaagttacagatgccacactctaggattttgtgactagtgctccaggaccagggacattggcatctgctgggagtgttttaggagggcaaaatcatagctctgtcccagatctatgaaatcagaatttgcatcataaagcaaatcccttgtgtagagttgtctgagctccttatacattctgataatcaatcctcattgattgctgtgcatgttgaggtgtgagaagcactgccctagcacagagagcagtatcacaccattaacttactcctggccattttctttctcttttgtccttctctcttccacctgtctcttcactctatataccagccatctagaactccaattacctgaaatgcaacctctttctttcttagtaaagtgctgttagtattacaaaacctttaaacatttagaaagttcaggggaaaatgtgatgaaaccctatgtatgcaccattaatatgtaacaaaaataaacttactatcattgagtcttttcttatttaaaaaaaaaatgctacaaggccaggcccggtatctcatgcctgtaatcctagcactttgggaggccaagcggagaggatcacttgaggccaggagtttgagaccagcctggccaacatggtgaaatcctgtctctaataaaaatacaaaaa

SEQ ID NO: 22 - DNA, 2798 bp, Homo sapiens
  nbla21729
caaaagatgctgttttacataaggctactcaataccctgataaattactggtctactaaggtgaatctgtatctgaattttattttcaaagaggatgaaaagattgttttaatacatactgttttgacatttctaccaatctgtgtgtctcaaagagatttgtgtgtttttgttgaatatggttttacctagtatttcctgacttcataattttattttgtaattaagcaatataagactataaataagagtgcttagagaaaacaaagactagtcagacctaaaattctaaattgggtatatatttttaagtattattcgaaccagagaaaagaagcacaagtgaaatagagcttaacctcatcagagtcacttgatccatggaaaccaaggggtagaaatttcccctccctgggcctttctgaggtatcctggtcattgattcttattaaacccttgggagtttagtatttaaaattccaaagcccattctggcaaaagtaatttcaagaactacctatttaatgggaaagccaattgaataataaaggccatgaattataatatatttagaatatattcagggttcctcccacgactccccccgccccccgagtatattatagtgtcaaaaagcatggctaatgggaagtgctgctaaaaagaggtcctgccagacctgctttatctaatcctgaggaattaattcagaacttaataggttttgcagttgtggtttgtttttaaaatatcaataattctgagtagattcaaggtcttttttttgttttgttttgttttgttttgtttttgagacggagtctcactctgttgctaggctagagtgcagtggcatgatctcggctcactgtaacctccgtctcctgggttcaagcaattctcctgcctcagccccctgagtagctaggattacaggtgtgcgctaccatgcccagctaattttagtatttttagtagagacaggattttaccatgttggccaagatggtctcgatctcttaaccttctgatccacccacctcggcctcccaaagtgctgggattacaggcatgagccaccacacccggcctcaattttttttttttttttttttttttttttactaacttagtcttctcctctcctctgtctacccttagcaatatataggtaaacatatccagcttgtctaacacatcacagattattagttaacaaggtgtagattaatgagcttatattgtattgctggatcttttgagttaataacaatggtaacttgtccagaaggcctatcatcattcctagtaggtgggcacagagtaagagatattaagaagcttcctgatgagtcatcatctagcgaaggccctgtgtagggctttattataggagttacattgacttctggggcattcaaaggtctcccctcttatccatatctctgtcattttgcttctccagccacgacaacacactttcctctccaactgctccctccccaccaaaaaagaagaccctctaaaaggcaaaggaataaatattcttagaagtaaattatcttcatcccatgctgcctttttcaaagaggtgttaggatatttatcctatttctgtatttcacagtagcttttcaggctgtcctgcttatatataagctgatttatattgagaaaaatcacttttgaataaagaggatgaaatgactttacaccccattaaatactcagtcaagcttagccatgactcagtaactaaaaagttcaaaaaatccagttatgtaatgtgcagagtaacaaattgcaagaaaaacaacttaatcttccagtgactaagtaagaaaaactgttgtcactattaaacatgtaggaaattgataattattacaaacaaagcaatactctaccctaaatctagacaaatcactggacagatgataagattttcagctttctcctttaaagagctgtgccaatgtacagatttttttgtaaacatgcaaagggaaggttacaaactccttaaactttaaaaaaccataaatcctttctttgctacttatattctatgccaattataatattccaagacttacctttcttcagaatgcttacatatggaaaggtttatttataaatatttgataggtaaatattccatatgtattttctagcccgtctttctctgtccctccctcaaataacttcattaccctctcctttttaaacgaaatatcttgataataagaaaacaaaatcatttttttgtgaaataatacatatggacaaaaaatacaagttgtattttacttctggttcattaaaatattgtgtttagttggattttttcctcctttattttcagaaacataaaagaaattgttttatttcctaaaggataaaattggatatagcctctttagtagacactatcacagttctgttgtttgctgtgttcatttgcttaatgaattgcgtgagaacagtcactgtaatgaaatatgtgtgctgggggtggggggaagggcatgggaaatgttttatgaaaaaaagttataagcctaatactatgaagtaacatctaatgcagttctttttaagtgcaatatatttatttctgctagaaatatattatcaaccttatgtaatatttgaagcattacatattatttgtaaacagcttaaaattatatattaccccaattgtacataagtacaaatgtgtggatattagtttctttcattaaaagtggtgtttttttaaaaatacatttgcacccatttacacctttcaaaaa

SEQ ID NO: 23 - DNA, 3322 bp, Homo sapiens
  nbla21831
ctcattttctcttgctgccgccatgattctgaggcctccccagccatgtggaactcttgtgttgtgtttttaatgggagagttggtcagcgtctgctggaacagagctacgcctatggaaccgtagacttgttcgtgctttattgcaatactttaaagacacaaagtctcaacaaccatcttccgcttgacgagacagatcattctaatttgagcagaagctactatgtcctgccctttgaacgcggcggcccggacagctgacaaggacacactgtgtatttccattccaattctgggagtgctctgaggcctctgggggagaaggacccatgaaatattcaaaacataagtgaataaaatatctaggtgctagatatgggccaggaagagccctcggccctgcaaagtgtgtgtgatggtgagaagctaccggaagagatggtccctgtgcttggttcattccttggacatttatcaagctgacgaatgtagcagaggtgcttcagtcggctgtaattccacgggtggagtgctggctggagagttacctggggctgtcacactgcatgggctccgggacactgtggctgcccttatgtggtgtccccggagggccctgcaggtgtcacaccgctgctccacactgccacctgctgtcagcatctgtgcaacgtatccaggtctctgggggctagaatgaaaaacatgcatctcgtaaccaatgaaatcgggcttgtcctgaagacctcgtgcattcatccattctcacactgctataaagacatacctaagactgggcacttcgtgaagaagggaggtttaattggctcacggttctgcgggctttacaggaagcatggcagcttccacttctagggaggcctcaggaaacttatagtcatggtggaaggtgaaggcgggacaaggcgtctcacatgggagcagtagagagagaaaaagaggggttgccgcacactttgaaacaaccagatctaacgataactcactatcatgagaacagcaccaagaagctggcgctaacccacttgtgaaggaccaccaccatgatccaatcccttcccaccaggtcccacttccaacgttggggattacacttcacggtcacatggagatggcagagcacctgcacgtgcacctggagaccctctcaagcctcgtctcctggcactgcctcctcctgacattggaggctgctgggagtaccagcctgtaaccctcgttgtgatggcacctgcctggtgctataattcagacatttgtctccccaacctcatgttgaaatttgaaccccaatgttggaggtgggacctgacagaaggtgcctaggacatgagagcttggtgctgtcctcgcggtcatgaatgcattcatgctttattccttctcacaagaactgattgttaaaaacgcttggcacctcctctgcccactctctcttgctccctctctcaccatatggtctgcatgcacctgctcccatcgccttagcatcgagtcggccttgttgacctactggaataattaggtctaagtggagttttaaggttactgatgacttacaaataatgggctctgattgggcaatactcatttgagttccttccatttgacctaatttaactggtgaaatttaaagtgaattcatgggctcatctttaaagcttttactaaaagattttcagctgaatggaactcattagctgtgtgcatataaaaagatcacatcaggtggatggagagacatttgatcccttgtttgcttaataaattataaaatgatggcttggaaaagcaggctagtctaaccatggtgctattattaggcttgcttgttacacacacaggtctaagcctagtatgtcaataaagcaaatacttactgttttgtttctattaatgattcccaaaccttgttgcaagtttttgcattggcatctttggatttcagtcttgatgtttgttctatcagacttaaccttttatttcctgtccttccttgaaattgctgattgttctgctccctctacagatatttatatcaattcctacagctttcccctgccatccctgaactctttctagcccttttagattttggcactgtgaaacccctgctggaaacctgagtgaccctccctccccaccaagagtccacagacctttcatctttcacgaacttgatcctgttagcaggtggtaataccatgggtgctgtgacactaacagtcattgagaggtgggaggaagtcccttttccttggactggtatcttttcaactattgttttatcctgtctttgggggcaatgtgtcaaaagtcccctcaggaattttcagaggaaagaacattttatgaggctttctctaaagtttcctttgtataggagtatgctcacttaaatttacagaaagaggtgagctgtgttaaacctcagagtttaaaagctactgataaactgaagaaagtgtctatattggaactagggtcatttgaaagcttcagtctcggaacatgacctttagtctgtggactccatttaaaaataggtatgaataagatgactaagaatgtaatggggaagaattgccctgcctgcccatctcagagccataaggtcatctttgctagagctatttttacctatgtatttatcgttcttgatcataagccgcttatttatatcatgtatctctaaggacctaaaagcactttatgtagtttttaattaatcttaagatctggttacggtaactaaaaaagcctgtctgccaaatccagtggaaacaagtgcatagatgtgaattggtttttaggggccccacttcccaattcattaggtatgactgtggaaatacagacaaggatcttagttgatattttgggcttggggcagtgagggcttaggacaccccaagtggtttgggaaaggaggaggggagtggtgggtttatagggggaggaggaggcaggtggtctaagtgctgactggctacgtagttcgggcaaatcctccaaaagggaaagggaggatttgcttagaaggatggcgctcccagtgactactttttgacttctgtttgtcttacgcttctctcagggaaaaacatgcagtcctctagtgtttcatgtacattctgtggggggtgaacaccttggttctggttaaacagctgtacttttgatagctgtgccaggaagggttaggaccaactacaaattaatgttggttgtcaaatgtagtgtgtttccctaactttctgtttttcctgagaaaaaaaaataaatcttttattcaaaaa

SEQ ID NO: 24 - DNA, 1823 bp, Homo sapiens
  nbla22826
tgcatttaagcaatccttccccttccttcagaatccccacctaatagccatgaagctgtagaaatggaaataaatccaaaatagcaccatcagaataagtgccatcagcaaaccagaaatttagttgtgttctggaaagccgaaagtaataaaaccctactgaaaaatacccctgaacagggaaggtcgtgacacagcaaaggaagaatcagacaggaacaagttttagtggtggtgggaacagcccccaggagccccaggaaagaccacatttccactggaccccaagagagaacaagtgcgaattgcttgcagtgatgggaacacctggccatccttcaaccattacccctccacccccatcctcacggattcccacacagagctttcaggatgattttttctcaaaaacccccaaaaacaaaaagtaccataatatttgctaaaaaaaaaaaaaaattgaacagttcactcctcactgagaactaataccaaagagagaaacagaatacattctaagatagtaccagaccttaaaaatagatgacatggagtaatggcagaagagtcaactatttctcaagggaaataaacaaaaattctatacacctaaagtacagtgctttatatttttcttagaggagtgggtggaggaagggcttgggcttacagcttgcctggaggcttctcttctcttgagccctaaatgaatccttcacatcagcataccctgcccacttacaaagagccataaatcagctcttccctacaaaggataggtgtgttagaaaaattgatcggaatactgatacaggaaagccacgccaactacctttgttaaccaattttttatttaaaaatatgaatatataaccagtgacgccaaaaagaaagactagtcccaaaggaaatctaggaaatctaattcaaggtaaagaagaaaaaagtttcaagtataattgcagtccttagaaagatttgaaattatttgtgttaaataaaaagagaacagattggtatgaaaaagaggtaattacagaacaaatgaacacttgagaattaaaaatatgattgacaaacaatagaagggatgataatagctgaagtctgaaacgttgaatataaagttgaaaactttttttttctgagtataaagcaaaacacagatggaaaatatgaaagggattgaagatacacagccagtcaaggtggcagaaaaagaaaatggagaggaatgaataataacagaaatagagcactaagggaaatgagcaacttacaatcagaaaagaaccccttacaaaaaaggaaacgagaccacgagcaagagcaagaacaaacaggacagcggagaatcagactcctaattcagaaactggggttatcaagcctagaatgtgaaattagagcccttgctttaatttctggaaataaaagagaggattggaaatgtggtaaagagcaagaaaacttggaggagtgttaaacagaattctaggaataaaataatataataggaattagaatttccatgggcagatgtaacagcacattagacatagctgagaaagaattaatgaattggaaagttgaatttaagaaattatctagaatgcagcctagagagacagaaatggaaaacaggaaattagttaagagacatggagataaagtggggaagtctaacatgcatctaactagaatttcagaaagggaaagggaagcgagacagtactgaagatgattgatggctgagaattttccagacttgaaagacattaatccacagagtcaagaaacccagtgaataccaaggataaaaa

SEQ ID NO: 25 - DNA, 1751 bp, Homo sapiens
  nbla23899
acaagatccaaggcatccggagagtagggaccatgcctccaatttcttccaggaggtctggtgacgctgaaggcagcctctaccttcctctgcgcctgactattccctgctctctgagctacttctcatctgggaaatggaggcataaccccagatgtacagggggattgataacacagatcaaacaatgagcgcgatgtcaggcgcacagcaggtcctcaggcagcactagctgaatatgtgaacaaatgagtggacagagggatggatggaaggattcttgaagcttccactgcacagggctgttgaaacaacacaacgcgggacctggatgtagatttcatctcgcagctgagccatgtgcttctctgccttgcatttcatccaagcccccagtatgagggggacacagggctggctcagagcaggccccgctcagcaaaactcactgaactcccaacagggcaaaacctgcaggccccacagggagcttgggacctgactgagaagaatcagggttcccaggggtctcagtcacagggaaggtcacatccatctctctggggaacattatcactgggttgaaatggaagccaaagggtaaaaagacacccgagtctgtgaagcaggaactggcaaagcccatgtggcagacatgcagcctcctataaccctctgccaaggccagcctggacccaccttctccacacagccctcccagacttcctctgtctggacacaacaggacccactggggaaaacaatgatgacttgggagtctgacaacctgggctccattcccaggtgtggcacgtactggatggatgaagggccagcattccctctatttttttatttttatttttttttttgagacagtcttggctcactgcagcctccgcctcctgggttgaagcaattctcctgccttagcctcccaagcagctggcactgcaggcatgagccaccacgcccggctaatttttgtattttcagtagagatggggttttaccatgttgtccaggctgctctcgaactcctagcctcaagcaatctgccctcctaggcctcccaaagtgctgggattacaggtgagaatctggcccccaactccccctcctgatgcctcagtttcctgccctgcaaaatggagatataatgccaacttcaaaagattgctgtgagtattatatgcgataatgcctggcaagagcccagtgggaggcctggctctaaagagggtggcagttttaatgagaaggtgtcagcactcagggaacgttgactggtgacctatgtgactgaggccactggggaggagaacctgcaggtcccaggacagggaagagactggtctgtccccaggaaactcctgggtttctgttcctctggcctaagggtcatagcaaggcaaaaggcaggaaagggtgaagagccgtgaaagtgatagaggctgctgggcgtggtggctcgcgcctgcaatcccagcactttgggaggctgaggcatgtggatcacctgaggtcggaagtttgagaccagcctggccaacctggtgaaggcctgtctctgctgaaaatgcagggattggccgggcgtggtggtgcatgcctgtagtccataatccctgctgccagggaggctgaggcagaagaatcgctattgaatccgagaggcggaggttgcagtgagccgaggtcgcaccactgcacttcaggctgggagacagagtgagactcagtctcaaaaa

SEQ ID NO: 26 - DNA, 1264 bp, Homo sapiens
  nbla20578
atgtgggatgtaaaattggatggggttagagatgagtgcaggcaattcaacgcattggtaggggtggaagttctcagcagaaatcaccatctgggtttttgctcccgtctcaacctagttgaggtctagagtgattaagctggagacttctgaggagagagaaatgaactaaagataaatacaactgatttaattttagccatagcagaacagaacaaagaagcaaccacatttcatctaatatcaagcacctactaaaggatgcattctgcaggccagctgcatctgcatccaaaccaaagtcactctggttgctcttttgctttgataacttaagagtttagaaacaagcggtttctaaaaaagccaagataacacaataaggaccaaattttaatcccacatagacaaagagattaaagtgggttttcctgaattgcttatgttatgaacaggttaccttgtcataatttggccttcggcttgggattctaactgttttaggccaccagttatgacactgacttactaatagctttggactttgaaactgtgtgagggtcatatagcctcagcagttttcttgtagcctgtgattgcattgagattatataatttttaaagacatggcctttggacctctgtctactagttaatctcttccatctaccattcaaatgtgctatatacaactatcatatcagcttcttagcaagcacttttctggacctctgtcacacccaccaagatgtctagttatgcctttcatttgagagtttccctttgctgtttttttttttttgttttgttttgttttgttttgttttgttttgtttttgagactgagtctcgctctgttgcctaggctggagtgcagtggcgtgatctcggctcactgcaatctccccctcctgggttaaagtgattttcctgcctcagcctccctagtagctgggattacaggcgcatgccaccacacctagctaatttttgtattagtagagatcgggtttcaccatgttggccaggctggtctcgaacacctgacctcaagttaatccacccaccttggcttccctaagtgctgggttttacaggcatgagccaccacgcccagcctccctttgcatgttttttaaaaaggcattaagcatcttgcacatgttctttagtttcagtttgcatgagtcaacctgtgtgcatcattttccctttcactatttcttgtctttgctggtgaaattttaaagcttcagtttaaaaa

SEQ ID NO: 27 - DNA, 1795 bp, Homo sapiens
  nbla21908
acagttgttgcaaagtgctcagcactaagggagccagcgcacagcacagccaggaaggcgagcgagcccagccagcccagccagcccagccagcccggaggtaaggaaacggtgctcgggcagcagctctgctcggaaagaaggcacggcttctgctcttaagccaagtggtcttttcaaaggccttctttaaaatcgctcagatgggtgcttttgagtctgcgggtctggtttctgaaaacccaggctgcacgcagctgcattgcaaagtgcttttgctaattcggagggcttcacctttctcttcagaaagcaaagggcagttttcttaagtcacttgcagaaggaaatttccatgtgtatttaggaatctggtgtttatttgctgtgtggctatttaagctccagtaagcaggggaactttgcaagaacacagactatccattctgcctgaccaatttggcatggggattagcttggcacccactgtttacctgttttgcttctagtatatcagtttggaaacagataaaattggcagtaaatacgtaattccagaatgatgaacactttattaagaggcatccttaaatggagcagaaaactgctgagaatctttgtgagtccaagatgtatttgaattcagtactttgggggatttaccagagtctgtaagtccggaagctataaacgtgaatgttaaacacagcccggtcttctcttctcttgatggcacgcttgctaatctaatttgagtattgttctcttagaaggtgttaagtccaacttcaattggggttgggggaagcacacacacaaatctactattttgcaatttaaatatactcttcaggtaaaatgtggattttgttcaattttgttggcatgtgcaaagattcaaggagtgactgagagaactttggagtgaggtcagggatgggtggttagccaagacttgtaacttccagggagaatgagaagttgtaaaagtcagactggctgtctctctttctctcttcctctttctttctttctttccttttgctcacaacaggattacttagtgtttcaaaagtgggagagagcctccttaaatggtttacagccctttgaatgtatttggtgcagtgacatcccctgaaacttcagtctgcaaagtctcaacatggtaactttgttcttttcttttttaaaggcagatgctgcttttagtgtccctttatttattccaggaaaaatgtggacatcagctaggcacgcctagcaaagaaagtggaggctgctggtttctgtgctttaactttccatagattttaaatggataaactgcttgcccttctttcatcagaatatgagctttccccagatggaaagtcttttctaaagcaaagttgcacatgggagctctagcttggaaacaatttgctcttttttccccagtctctgccataaacacttgaatgtgcacacaactgcagagcttaatgccacaacctccaggagattggggggaggggaaagctgcccaggatgggggtgggaaagcgaaggaagatggagaaatggctgcagtttgctgcccatcagcttttctcttttaaggggcagacattgcagacgtagttttaaaaaagttccataaagcatcgccaaggcagcatgcctgtgcgacacacgcagggctttgggggtgtgttttccccgtattaacagcaagtcgttgaagcgttgagaaggtattatgatttctaatcaggcccagaacaggccaagtataggctttctgaatgaaaaa

SEQ ID NO: 28 - DNA, 1620 bp, Homo sapiens
  nbla22027
ttgatgcataaatggttggacagatgggggggtgggtggatgagtgggtcgatggatggatggattaataggtgagaaatatttggatggatgaataaatgttttgatgcatagatggatggacagatggatgaatggacaggtggatggatagataaatggataagtggatggatgggtagaaggatgcatggaaggatggatggatgaacagatggatggatggatggatagaaaaagaaatagagaattaaggaccactgggggagggatggattggtgggtgactggatcagttggtggatggatcttggtggactgcctgtctccttcaacccctatccatccaaccacaatctctttgctgttttccctttcaagtctgccctcctctgaccattcccctcctgttcctcttgggcatggccttctccctcatagtccctgatctccatccttcctgtttcggttcatcccccacactgttctttcaaacatgaaagtctggctgtgtctccctcttgaacactccatggctccccactacccccatcctgataaaacccaagccttcctcccagacattggggccccttcccatctggtccctgctgactagtccaaccaccactcactcttctcttcatgcatcagatatcatagccccatcaaaccacccaggggtccctgtacaggctgtgggccctctttcctatctgtggaatgccttgcccacctgttaagggaaggtgatctgtgggtgggggcgagctgggccctctctcagacctgcccctcgtccccagcctgaccctctttgccaaaatctgtgagaagactgtgctgaagcgagtgctgaaggagctgtggaagctggttatgaacaccatggagaaaaccatcgtcctgccgcccctcactgaccagacggtgagacctgcagggggcccgaggggacatttaggccacctccctggcgagagcccagaaaacttggtgcctagaggctgggggtaagaacaaaggcatccggtctcagagaggtcatccaggctcaagggccattcaagggtcatggaagccaccagaggtcagtggggggccattcagaggtcagagagttcacacaggggttaaagatcatcgaagagttaaagaggtcattcagagtccattgtattttctctggggtcaaagacatcaggtagagtcaagagaccactaaagtcatagaggtcacatgtaggtcaaaatagctttcaaaggtcagaggtcatctagaaaacaggtcaattttgggatcaaggttatccttgagccacggaaggcatagacattggccaggcaccgtggctcacgcctgcaatcccagcactttgggaggctcgaggcgggcagattgcttgaggtcaggagttcgagaccagcctgggcaacatggtgaaatctcgtctctactaaaaatacaaaaattagctgggtgtgatcctgtgatcctggcttcttgggaaactgaggcacgaaaactgtttgaacctaagaggtagaggctgcagtgagctgagatggcgccactgcacactccagcctgggcaacagaacgagaccctttctcaaaaa

SEQ ID NO: 29 - DNA, 1426 bp, Homo sapiens
  nbla22082
gagggcccatgtgctgaaaatccgaagtgccgcggaaagtggaggtgagggccgcccgccctagaggtgcccgtccgagaggcaggtgcgggaagagcctatccttttccctggccatggctcagtcgcctccccagggtttatttgcaccggaagtttggagcgggtgggtgctgaagacagctaggccttggcgatgtctgggatgaggctggtgggggaagcctttggagccgtgacctgagagggcagaccttcgaccccactacattgcactgcgccttcagaacatgcagggaaaaccccactgcgggacgctcaccagcagcatctccagattgtgaagggaaagaagggaaggatctcgggggcatgcaagctgctctgggctggggtggttcagacctggattgactgaggtgaaggggctccttgcagcaatcacacagaaggctcgggtcttaagattggccctgctcctagtcaagctgtatgaaccagggtagtcactccggctttcagggccttgatttccttgtctgtaaaagggactttacgatgcatctggcaacctcaccttcctcactgggcaatgtgaagaccaaatgccggcaatgaaattcccagcattaggtttgtcatatagtagtcctctctaagcatttgttgaatactcacaggaacacttaggccagtcagcattaattgaaaataacaggtggggtttttttttttgtttgtttttgtttctttttccgaaaataacatcaggcctttatactgagaagtataaagaagaaaaatgagccagtatctcactgttcagataaaccgttaatacatatttttaaatgcacatggttagaaaatgcaaacgttacgggaaggaacaaaatggaattaacagacctcccaaacagttcctctccccttaaacaagtactttggtttcttgtttcctttccataaatataactgtgctggaatatatatttgtatatttaccccacagggataataatacattattttgcaccttgctttgttaaaatatttaaaataatttaaatgacacccacaaccctgtaaatgtttatggatgatgaaactgaaattcaaaagttaaattgctggatgggcgtggtggctcacacctgtaatcccagtactctgggaggccaaggcagatggatcacctgaggtcaggagttcgagaccagcctggccaacatggtgaaaccctgtctctactaaaaatacaaaaaaaaatttagcgggtcatggtggcacatgcctgtaatcctagctattcaggaggctgaggcaggagaatcgcttgaacccaagacgcagaggtcgtggtgagctgagatcatgccactgcactccagcctgggcgacagaacaagactccgtctcagaaaaa

SEQ ID NO: 30 - DNA, 2062 bp, Homo sapiens
  nbla23303
gagcttgagctgagatggactggtcttcatgggcgcccaaggcgctgggtgcagctttccccgagacccccagatggaaaggagggaaggaggaaccccacacactcgccttttgcgagaagatcggcgcgcaccccagagtgccccaagcctttggaatctgcctgctgagcggagcgcgcgagcgtggtggacaggtcccgaacttggccagcgggctttcttggcaacttgctttgcgcagttctccatggaaccctggacccactgtgctcccggcgccttgcctttttttttctttttctttctctcactgtctctttttaaatttatgaactcgaaatgaagcggaaagcagatatgcgcgtcagcatactttggcggtagttcttcatgtgggggatggtcagcgggagatggcacttcataagatctgcggtggtcaccccagtcatcatccgacgtgttgcaccagtctgtggcacttcataaggtctgcagtggtcaccccagtcatcatccgatgtgttgcaccagtttgtggcacttcctaagttctgcggtggtcaccccagtcatcatccgacgtgttgcaccagtgtgtgttgctgtttgagccgtgctgccgaccccttccagggcatctgccacgggcacctcctccagcccgtgcactaagactcaagagagtcgaagaaccagggaatcgttgtaataacaagcattctgaattgcatcgtactgtgtactagaccttttaaaaatggaactgtcggctgcggctggaaggcgcaggcaggcgccctggagagaattcacagggaggcacaggacagaacgctcccaggaacgaggaagcacccccagaaaggagcgctctatgggctccaggcagccgaggaaacgcgaacgtgagccccgtgactgcactcccacgtgcaccaacgctgccagtgtgagcagaagcggagcccgcagagcgccaggctgcgccgggagatgcatcacgatgaaaaactgcgccagagcatggcgggaactttccgagagggcgtgttgtttccaggcggttccaccttctaatatgaaacagtcttggttgattttccttgatactactttatgctcggcctggttgttggcaagtagctgcccgcgtctgtacgcgcccttgattagtttccactgcatgtgttttaacacagtcctcctttttccacgtttatttgggccaaccctgtctgcaaagatccagtttaatacagatttgagtctacgtgctatagcctggaaatgtactaaagacactacaacatattgctgaaagaatagaatctttattctgaatgcaaagcggacacctagtaaaaaattctggaataataaaacaagcaaggcttatgtgctcagttttggggacgcttcaatttaaaggcttagtcattgtcacggtgtaaggtttacccattgcccccatcacacagatgtgggattgttgagagctgagtgtcctatgacctcttctgctgcccaagaacttggggtgggtggtaactggagaaatcaaagtgatcagctgcaaagaacgcttccattgctggagcttggttgtgcgggattctccacggaggtcttaaggcagagacaaaaacaaggactttgggaggctcctgtgagcagccaaaagggtttagagtcaggcagcctcaggttacaaatccagtcctgcaggctaggagttgtgtaagcttaaaaaagtgactgcacttccaggaacatcatttccctacctgctcctccttctgacgggttttctgaggacaatggaatccacactctgtgtcgaacacttttctaattagcgatgtgcagacactgtttattttacaggaataaaaatgccagaagaacccaagtcatattcatttaaagcagggtgacaagtacaccaaaatctgaaaaatcatcactaaagaacttatccatgtaaccaaaaaccattgaaataaaagtaaactatggaaacaaaatttaaaagtaataaaatttaaaagtccaaaaa

SEQ ID NO: 31 - DNA, 1592 bp, Homo sapiens
  nbla20264
ggtccttggagcttggaagatttatgcatataggagagtgagatctctggtagtagaagcataattaattagatgcccactaaataacctaaacttttcatcaaagaaatgaacaatgctatacatttgagttccccttactcttgagggatgaagaaaggcttaagttgaccgttgggcagatgttagcttgtgtctgagatctgtttctctaaaaaggataaggtcttctctaccctctcccttaatcatcagacacaggactggcttcatgggcatgtgacatgtgcagtcacacaaggccccattcttagaagggcctcacacttggtttaatgagctgctgccaccatcttgtaattcttaatcaagttttttaaagggactctgtattttcattttgcactagtccctccaattatatgtttggacctgacagacatatgttgctgctaggactggtgagaaaggaaatgaggccatcccactaactgtagtatttatagatggcagatcctggtggttgtgaaaagtgggggctttgtgcacttgtaagagcatttgcagtgcagtacatggtaacactcatccatgaaataatgaccagtttgaaatgctttctagtataaacgctacagtgatgtcagctgaaacatgaatgttagaaggtatctgttcattcttcgtaacccctaacgtgtaaacctgggatgttccctcacctagcttttaactgaaaggtggttatattttgaatccctaaatcaagaagtcccagagcagctttattatcaaacttggaatccagcattcatcactgtgtttcactcttctatgttggaatattaacagcactggagtcccataaattatgtatttgttgctgaatgttgctgccagctatgagtggcaaagcagttccttatgtagcttattttggttttacaagatcattgatgtgtatcaagatggctcaacaaatgaaatgtagttcaaatcatagagttacgagtctgtgcaactagattgatttttcttgcccttgagtgtcacagtggtggcactctatactttaaaaagtgtgaaataacaaccaggagagatagggaaaacccaattggcttttaaaaaaatgaatacatgtcaaagattttatattaggcattaattaataattaattaactggcaaagtaagtggttactgcagtccaaaggaaaatccaaagagtagacacatacataggcaatggagaatgtgaaaatgaatttgttagcagacgcacagctggcttctcccatgggcagggtggagtgtgggattaggtgtgtcttaactggacaagatttgtttgcagtaatatcagtattctttaagagttgtaaatagattagtaaaaatactaaaaggtgtagtcccctgtagaatcagatagcccagaaaagtgtgctagacaacacctgaagttccgctgaaaagatacccagtgatcactttttgcccatttcaaatctttctcagtttatctgactgtgcttcccccctcctcccctgtgatcgtaataatctcagtgattatccttcatttaaaaa

SEQ ID NO: 32 - DNA, 859 bp, Homo sapiens
  nbla20269
aaaaaggaggggcgtacgcgggcaagatggaggcgactacggctggtgtgggccggctagaggaagaggcgttgcggcgaaaggaacggctgaaggccctacgggagaaaaccgggcgcaaggacaaggaagatggggagccaaagaccaagcatctcagagaagaggaggaagaaggcgagaagcacagggaacttaggctgcggaactatgtcccggaggatgaggacctgaagaagaggagggtgccccaggccaaaccggttgcagtggaggagaaggtgaaggagcagctggaggccgccaagcccgagcccgtcatcgaggaggtggacctggccaacctcgctcctcggaagcctgactgggacctcaagagagatgtggccaagaagctggagaaactaaaaaagcggactcagagggccattgccgagctgatccgtgaaaggctgaaaggccaggaagacagcctagcctctgcagtggatgctgccaccgaacaaaagacctgtgactccgactgaggcatgccctgccccaccactcgcccatcaggcctgtcctgcaggggatggtcttgggcagggatgggggctaggcttgccatcacctccagtttggcttctgagcagagactccctgcccatcaagtctgaaacccccatggatgaggtcagctccttgtctgctgggtggcccctgccattctgaatggaggcagaaccagcaacaactctgggcgtgcctgtgtctgcacatgtggatgtacatatgtctgtatatatgtatatattttgaactttctaaaaaaaaaatctggaaatagaaacaagtaaacccctgtgtgtggcaaaaa

SEQ ID NO: 33 - DNA, 1800 bp, Homo sapiens
  nbla20406
gattttgagcttgcattagaaaactgtccaactcacagaaatgcaagaaaatacctctgccagacacttgtagagagaggaggacagttagaagaagaagaaaagtttttaaatgctgaaagttactataagaaagctttggctttggatgagacttttaaagatgcagaggatgctttgcagaaacttcataaatatatgcaggtgattccttatttcctcttagaaatttagtgatatttgaaataatgcccaaacttaattttctcctgaggaaaactattctacattacttaagtaaggcattatgaaaagtttctttttaggtatagtttttcctaattgggtttgacattgcttcatagtgcctctgtttttgtccataatcgaaagtaaagatagctgtgagaaaactattacctaaatttggtatgttgttttgagaaatgtccttatagggagctcacctggtggtttttaaattattgttgctactataattgagctaattataaaaacctttttgagacatattttaaattgtcttttcctgtaatactgatgatgatgttttctcatgcattttcttctgaattggaccattgctgctgtgtctgtgacatctggtgctgctcatccccatccacaaactggaaaatgatttcctatgtaatcatgcatccaactgggctgtgctatttttttaaatggtttgtatttgaacatggtgattcctccttcacttcaccttaacggaatgtctttatttgaattttatttgtaaaatgtgtcctgtttaaatttttcaatctttaaaaataatttttatgtactttttttttttttttaacctttcttgcactctgggtcatgggtaccactgcaatggcttcccctttttttatgggataccaactgcaatatggtcctcaatgctgttctggccatttcaatgactaatgccaaacatctgtatgactaatttttttatgttaaaaaaatactgtttaatgctggctctatggtgatttggttttactaaattgggtttctcgttgggggtggtcttttgaatactgggttttatatattctgctatttttaacgtgtggtttttttcgatatctgggttctaaaagaaatctttggaattaagagaaaaacaagctgaaaaggaagaaaagcagaaaacaaagaaaatagaaacaagtgcagaaaagttgcgtaagctcttaaaagaagagaagaggtaaactataatattcagtatttttaaacttaaggcaactactgaattgaacccaaagtgccatactggaggtaaagtaaataaaaatatgaaagtatttcaagtgccaatcagtgactgttaagaatctttagcaaatatgtgttccatgtattttcttattaaagagatgaagtggaatttaaggctagaattctacaaaaaaagagtatcttagaattaaaatatagaataagttactttaattatgttttaggaagaaatattttagaactagagcagtggttctcaactaggggtggatttattcacccggggacatttgacaagatgtggagacatttttgattgccataactgatagggtgctactgcatctagtgtataatggtcagggatgctcttaaacatattttaaagttggacgccatgtggatgctatgaatgaatacaataaagctttggaaatagacaaacaaaacgtggaagctttggtagctcgtggagcattatatgcgacaaaaggaagtttgaacaaagcaatagaaaaa

SEQ ID NO: 34 - DNA, 1716 bp, Homo sapiens
  nbla20949
gttgtccaagatggagggcgctccaccggggtcgctcgccctccggctcctgctgttcgtggcgctacccgcctccggctggctgacgacgggcgcccccgagccgccgccgctgtccggagccccacaggacggcatcagaattaatgtaactacactgaaagatgatggggacatatctaaacagcaggttgttcttaacataacctatgagagtggacaggtgtatgtaaatgacttacctgtaaatagtggtgtaacccgaataagctgtcagactttgatagtgaagaatgaaaatcttgaaaatttggaggaaaaagaatattttggaattgtcagtgtaaggattttagttcatgagtggcctatgacatctggttccagtttgcaactaattgtcattcaagaagaggtagtagagattgatggaaaacaagttcagcaaaaggatgtcactgaaattgatattttagttaagaaccggggagtactcagacattcaaactataccctccctttggaagaaagcatgctctactctatttctcgagacagtgacattttatttacccttcctaacctctccaaaaaagaaagtgttagttcactgcaaaccactagccagtatcttatcaggaatgtggaaaccactgtagatgaagatgttttacctggcaagttacctgaaactcctctcagagcagagccgccatcttcatataaggtaatgtgttagtggatggaaaagtttagaaaagatctgtgtaggttctggagcaacgttttcccagtattctttcagtttttgaacatcatggtggttggaattacaggagcagctgtggtaataaccatcttaaaggtgtttttcccagtttctgaatacaaaggaattcttcagttggataaagtggacgtcatacctgtgacagctatcaacttatatccagatggtccagagaaaagagctgaaaaccttgaagataaaacatgtatttaaaacgccatctcatatcatggactccgaagtagcctgttgcctccaaatttgccacttgaatataattttctttaaatcgttaagaatcagtttatacactagagaaattgctaaactctaagactgcctgaaaattgacctttacagtgccaagttaaagtttaccttattctcggccgggtgcagtggctcatgcctgtaatcccaggactttgggaggccaatgcgggcggatcacgaggtcagatcaagaccatcctgccaacatggtgaaaccctgtctctactaaaaaaaataaaaaaaattagctgggtgtggcggtgcacgcctgtagtcccagctacttgggaggctgaggcaggagaattgcttgaacccgggaggcggaggctgcagtgagccaagatcacgccactgcactccagcctgggtgacagagcgagactctgtttcaaaaaaaaaaagttgaccttattctctaaaagggctggctattcatatgatgaattgttaaggaaaacttaaagtggaagagaacacatgtgaagagactttgaaattatcaaaagaaaaaaaaaagaccagacaaaatctcatgtgccaataacttttcaaggtgcctttgttaaggaaattatatccacttaattactataatatataagactttatgaaaagcactttataaaattctaatttaaaaggtcaaaaa

SEQ ID NO: 35 - DNA, 2442 bp, Homo sapiens
  nbla21251
ctcctgagctccatcctaggggtttttaatttaaccaacagccatgttgacaaaagccaacaataagcatgtcttattctagccctgatcccaacactgaaagcgaagtactttataaagaagccagcaattatgagggtttctttatgttagtaggggaaaaaatggtaataaaagtaccagtgtagcaagtgaagaccaaatttatagcactgtgcattagatagcaaaatcaggttcttaacaatgaaaagtaaacctcaagtttctaaatccatatgcagatggttaggctgtccctctcttagcaaatctctcagcctccttctttcccaagtgccaaggatccctggagtaaagctctggggtctgtgctctctttctgtgaggggaaggctgcggccctatttgcccctctctagcaaacacccccaccaccctgccgcttcctgtggttattgagccagctaggagttactcatggactctaacctggttttagtcccatgtacatcgttgttttaggtttcatactgaagagccaatggtttatgtggttttattctgtcttaaatataagtttcaaggaagggaaaacaaaagtgataaaatgatagaacagtctagaggccactgtaaagtcaccgccactttacgtgtatgtcagtcttggtgttcttgtatgagtaaaatggatgtaaaatcataaaatcacagtgaatgtttcaggctacactggaaaaagtatgcacttagaattaaaggaaattgtataattcaccaagatttctttgtgtagatcaggggttggcaactatgacccacaggctaagactggtcagcggtctggtttttcacagccatgagctaagttacctttttaaagggttatataagtaattacatcatatttttgattttgcctttggcccacaccacataaaatattcaatacctggccttttttttttttgagacagagtctcgctctgtcacccaggatagagtgcactggtgcgattttggctcactgcaacctcttcctcctgggttcaagcaattctccctgcctcagcctctaagtagctgggactacaggcacccactaccatgccttgctaatttttgtatttttaatagagatggggtttcaccatgttggccaggctggtctcgaactcctgacctcaggggatccgcccgccttggcctcccaaactgctgggattacaggtgagccactgcgcccagccaatacctggccttttaagaagtttgctgactcctggtatggatgacagaaaatggaataacgttttgtttctccagtctaggaaaagcaagtcaggtagtggatagactgactggcgtccggggagcccagggtatgtgagggccacgtggatggaagcaaatgcctcctgcatagcccttggctctttgtcccacttgggaggagtccatggatgtaatatttacaaaacaattttttccttaccatttgcagaaagcattgcatatatttccttttagctcaggaaactggcatgccccaccctctgctactccatcagatgtaaatacaatgactataagccgtacaactcccctctcttagaaacctcagcaggaccacagagcaagggagtcaaagctttcttaattctctccagtaaatgactcaactaatttgatttttttaattaagtcaaaatatcaagagaaaaattgctactaaaacttacattttgatccacactgatgtgcaacacaaaatgaaagttttcacctccattccattttttaaaaattcacggtccacactgaaacttgctgggttttagcaggagacaaaggtgtcacccacgctgtcctcatcctgctctctctgtcccagtgacgctccagcatatgatcactgcagccggtccctggcccgtgccgattctgccacctcccagccacacacatttgcagacccacaagaagaactgtagccttgataatttcagttcaggctggaaaaatgccatgcaataatctggtttgctttcagtaagtaggcaacaagtgaaaactgtataattttcatcacctattctgctgttctatctaaaatgagtgtacctgtggtttgtgaactgggcccttgtttgtgccagatccttcaaagatgttccctgtcaggacacctgtggccctgcccctcctcagacaccttcccactggcattcacgttccttatatgcagtgttagccatctttggcctacgtggactttttttgtaaattacaccatttccagacattaaactttttatattatgaaatttaccatgtaaaaagaacttcatatttttattgagattgctaaggcacttggccttcctcctttgtgattttcagtgtctattaaagcatgagttccctcagttttaaaaa

SEQ ID NO: 36 - DNA, 1731 bp, Homo sapiens
  nbla21334
attaaattcaacaataaattttatatgaatgatttggtaaaatgaatattttaaaaacccaccaaaaaagtaatagggaactctcatatatgctcacacacaagataaaatgcagacagtttttaaaataaaaagccaataccagcatgttctaatatcatagagcagattaaatgaattctagcaaagtgcatttttgatttgaaatttccaaaagctgctagcatacttcaggtgcacacttatattggctgggttattcccttttaatagctatcacacacacgaacacatttaaaataacatatccataaagtgacattttggttcatgtttcttaggtttttgacacaagtagcaagagaacattgaactctactttgcagagcacagaatatccttcctctttgctaataaagtgagcactcacataagttaaacccaccagagttatacatttttcactaaaaaacttgcatgaaatgtctgcttgaagaggagacagtaaattaatcattaatttagatggtatttggaaactctagttactgtatttcctctgttcattttcataataaaggatacctgactatcgcagctaaagagaaatgatccctagaagtttttagagataaacatgggaattgctgttatatatgttatatatgtgtgtatatatattacatctgtatatatgaataccactaacataaataggctggtatggaagcaaatataaacttttgcatgaaaaaagttcaggaaattgaaggcatggatttcaaaatagtgatttttttaatcttgcaaaaacttggaattatgcgaatctttttgaggagctctaatgtagaatttgtttgtttttatattttttaagttctcataatcataatttcttgaaatacttatataactatgaatttttgcaatttaattcttaaaagattattggtttgtcttcctaagtgaaggatatagaataaatgcttttaacaatcatatttgaagttgaattccaaacacaatctagcaatatcatactgtgaccttcactgcttaccattcttacttctcacaggagtaaaatcaagctggagccatcaagaatgcagctctggtgttttttaaccagccagaggctcgtgccaccacttttacccaggttatccaagcaagttgtacatgtacaatcacgttctaaatgaattttgactggcctgcatgctactcagctatgttccttcccctgccatggcaaggaagtgctagacttgcccagctgctctctgctgaatcgtgtgacacatcacagcatggtcaggcgagatgggcaatcccaacatcatatttaattctgctaatgagttttctaatttagtctttagccttttaaaaccaattgcatgctctataggatttgtaatatctattttaaaacatgataggaatgtttatggttcaatatagtcagggatgtaggagggcatgcatttttttgtttctctgcttttatttcattaaaataagaccacaactttttattgttgattcagcctttataagtaaattgtattaccaaaataagcctcacagggtttttttctgatagtactgccactttcagatcattatattcagatctatgaatataattttcagcctatccaattcatgtgctccagatgaaaatgtttgctttcatgttttgggggaaaggttctgtaaaaa

SEQ ID NO: 37 - DNA, 3077 bp, Homo sapiens
  nbla21356
gactcggtgaaaaaaatgcattttcccctggctgtttgaaaatttacttatttgcagataagtctagatttagtcttggagatcaaagtcttttatattttaaaaacttattctttatattgatcaaacatggcatatgttagagaaccacttcttctgtcatgtttatgtattttggaattaagttgtttgcattcactttcaaaatctgcccatttctgtttatgtgcacttaccacagatgtgtcgggactttgcctcaggggagaggtactttagcacctgtgtcactgaggagatggagtggttgacaagtactgttgcgctgtgtaacttggggtttggccctgtggacaatatattagcagaatgataccacacaaaagtattacaggattaaggcatgtaacttctatggtagtccttatgtatcagcgtatacccaagttcagaaaccacaggtgcatttttagacctttacttagagaactaaaggcagttccaaccatcagcccatatggcgggattaatgcatgaaaaccctcagagggtgttgggacatcctacttccctgtcctcacccagtggaactctggtgtgtgccttgaggataaggaagtagagtggaaactcatcctatcattgagtattctcaatattttggccttccctctggaattatgagaaatttaacaaagtctcaggaacctttagaatccattgtccaacactgctagaaaaactgtaggaggtacatggagaattcctatagttcttaggtaagtgcaagacatggcacagggatccctatccacataaaggggaatctggatgctgcacacctcaattctgagaaatccctgactgaacttggaattatgacagtaaagttttcgtcctttagttttctagagcagctcacagaaattttaaaaagtaaaacaaggccaggcgcagtggctcatgcctgtaatcccagctctttgggaggctgaggcgggcagatcacgaggtgaggagatcgagaccatcctggctaacagggtgaaaccccgtctctactgaaaatacaaaaaattagctgggcatggtggcgggcgcctgtagtcccagatgctcaggaggctgaggcaggagaatcgcttgaacctgggaggcagaagattacagtaagccaagatcgccccactgcactccagcctgggcgacagagtgagactccgtctcaaaaaaaaaaaaaaaaaaaaaagtaaaacaaaaataaagtctatgcccattaagacgtcttctaattcagttgtgattgtctgctcctacttaaaaaaatatttaagcttgatgtttaattattccctttcagcaaatttggatcagaaaattaaagtatgtgacaagatcaggtcaccttgaatttccacacaatctcaagacactgaatagcaaaaaagtaacattacatagtaatgattaggatatttccttagactttgctggatctttggtcttaaggtaacatgtaaaagtagtgaagcctttcctttcatggccctgtgcaatgtaacggttttctgcctcctcttcagctggaagcgttagtggtagtatgggcacagaatatatgtacactggcgatgctgaccatgcctcccaggtaccctggctctgggttccttgacctagggaacaagattggatgaggcagatctttgagcccatgtgactatagaatttgctgatgatataattttacaataacaatggataggaattttacctctctttttattagtttaatattatttaatattatgtacataagtgttcactcgcctaattaaaaacattgagtaaaccaagtttttatatagactacccttgccatatgatgctctttttctctaataatatgcagtttaaatcctgaggaatcaatgcccagcatttcaccacatctgaactctgtgtgggcattcttcactcgcctacaaggggtaaacaaggctaccagaacttgaatttgacttatagggagctacccaggaaggggaaagcccttgggactttttccaaaacaatcttctatttgaactgttcatcagccaaagtagtccactgaggtgacaaagctttcagaaatacaaagatgggaagataaaggtaacactggcccacttggggctttgacattggattgggtggactgaataaacacagcctaggtggcctgggcttgagcctcacttacttctccttgatacatagttcctggtctaccttctgaccctttttctaaaatagccagtgtctatttcactaggccatttacttacaagttcccagcttttagggaaaaaagagggaggggggagcatctagttttgaattagatatacatcttagaagtaatgagctattggcagctgttaaatcagattcagccacaaaccagaattctttcttgttgaacaagaccaatgagttagatgactttaataattccacttttctctccctctcttctcctcttcctgaaatcagagagatgagaaactactctttgaaatacctccagaggcgttttattgtgttcctttcccctccaagcagctccctttatacaattttgctcaggcaaccaaggacagagtatcggcagaaacatggagtgcttttgtataggccacctgtacataaaagtgtaattatttatttaattttcccatttgtatcatattaaagctttgtacagtgttttaagttctgttttaaaattattttgtattttatttttataacctagtaataaaatattcattccgcatgcaaaatctagttctgtttgtgtgatggtctggatttcaaaagtggaaaatatttttctaatttaataaagttattgaatacaccagatgttacaagatcaacggggagcagatagtgttactgtaaatgcagtaccacatctagaagttccctagaaaaagcagcccaggactgaatagaagctaggtgttaagtgtccctgcagttaggagatgttttcctgtaataaaattaaaatattaaaagctcaaaaa

SEQ ID NO: 38 - DNA, 2043 bp, Homo sapiens
  nbla21418
gcaagtaggggcaaaaagacacaagcaacataagtaagcatgtgtgcagtgtgttatgtgataagtattacataacagggatgtgtgtcacagcggggaagggggaagagggtgagctgggatatgtttgtaattcagatgaggttcttggggaagatctcactaaggagatgacattgaggaaagacctgaaggaggtgaggcagcaagccatgaggaagaacattctaggcagaaggaagaaagcaagtgcaaagacttcacctcgagggaggagcgtttgaatgattttgcagaaaaacagagaggccggtatgactggacagtctgagtaaagagaagaatgagatgggatggattcagttgcaagtgattgaaatgaataacaagcattcatcgatccaaggattcaatgaccctaagtattcttaggtagaaagcagggtgacaggcagggtgaaataaaatcttcctctattctgtagagctgtgacttaacctttcagtcttgtgaaaatatgtatttattggtactgctggacagttttcctgctggctgtggagagagtcttggtgaacagagaggcctgcagcaaaagagttaagagatactttctactctagatgaatcagacagaaatgagtcattttttaaattacagaggtggacaccactttacttagcaactgtccttttgaaaattagctttaattttttttatttcagtcataatcacggaactataattactggaaaggaccttgtttgtcatctaacccagctctcattttatagtttcttaagaaactaaggtatgaagtgtagctgaaatactattacaaataaatctattcactatttaaaacagtattctcataaggaatcttttgaaaaatatatataatcccttaaatttatagtttcaaaaatgttttaaaatatttatgaagtccctactatgtatttgacactattctggcatctgggaattcagccacaattaataaggtagatttcatccctactcagtcagcatttacattgtgctgtgaggtgggagtagggctagggagagctgggagtagtatgtatagatgacaaaccagtatgttaatatatggacaaaataatttcagagaaagataagtgatataaagacaatcaaagcacagtgatgaatcagaagaattagaaagtaccagagctgtggccatgcagtgccgctctgagaaggtgaactttgagcagagaacagatccaccttcaggagttagtggtatgggaatggcatggggaggggaccaggttttccagtcagagggtacagccagcacaaaggcccgagcttgctgtgttcaaagaacagacaaaaaaaccgcatggttgaaatgtaatggaggtgtgatatgtaagatgggtgtggagaggtgcaaggtggccagcccacatggggcctcttaaagactgtggttagacaggtctacgaaaatgtcagaaagctttcaacagggaaatgttgacatcaggcttcatttttcagaagatctggcttctgtgtggagaatggactatgttgggacaaaagacgaagtgaggagattagatagatgccaattttaccagctccggcaagagaggttgaggcttatgcttggttagcactggaagtgaagaagtaggagcagactggattcttttctatcagatttggagtaccattagccgtataaatcattgtggggcggggaatgcctggtgccgtggctcgtgcctgtaatcccagcactttgggaggccaaggttgggagcattgcatgaggccaggagttccaaactagtctgggcaacacagcaagaccctgtttctacaaaaaaataaaattaaaaattaggtagacgtggtcacatgcaccagtagtcccagctactgggaaggctaaggctggaggatcttttgagcccaggattttgaagctgcactgagccgtgatctcaccacggcactccagcctgtgcaacacagtgagaccctgtctcaaaaa

SEQ ID NO: 39 - DNA, 1181 bp, Homo sapiens
  nbla21480
atatgcaacggtcagttcctttagatatattttactagctttcctttttggtcatgctggaaagaattccagttcttttgggggggtgggagcagaacaaaatgaaaataactactatttagatttaaaatgtttttaccatttcctgaatccttggactgttttctgtttggttgctccacactataggattcagtttgagtatttgggtaccatccatccctcccagaaggtaagctggttgatgcaacttttgtggataataagtggctctgttctggttgatggtgtttctgagaagtatagacagagaagctgtctaaacataaggaacaaagtcagtatcagtgttacatgaactgtgaacatcatctggaagccaatgaatggatccctattgtgaagtgaggcgctcaaagagatgtatcatactttgatcttaagtaaatgtgctggttcgttccacattgctctgcctttggagcagtctgtgatgaaggtgacctaaaaagtgagcaccattagaacttgattgctgtcccaaaccatcatatctttaaaaatcctatgatcttcttagttatgcaggtaattgaataccttgttaaataccaggaatgtaaatggccagaaacctaacagtgtaaaagagtgaaatttattagtagttcctctcataagactattttgtaaagaaataactagagatatgtttgatatttatagcacattcattgcaaccattaaaaatatcaaaattgattatgtgggaaaatgtttaatgggaattgctcagtttttttccataaaggattatagaatatgttcaatatgatcccactttttgaaaatactcaggaaaaaaggatgtatacccagctgggcacagtgactcacacctgtaatcctaacactttgggaggctcagtgggaggatcacttgaggccaggagtttgagaccagcctggtcaacatagtgggactacatctctaccaaaaaaaaaaaaatatatatatatatattagctgggcatggtggtgcatacctgtagtcccagctactcaggagatctgaggtgagaggatttcttgagcccaggagttggaggctgcagtgagtgaggattgcaccacttcactccagcctggacgacagagcaagatcctgtctcaggaaaaa

SEQ ID NO: 40 - DNA, 2312 bp, Homo sapiens
  nbla21509
aacgatgacctgaccaccaagccaccataggaaggagccacggagctgcctcctaggccaggatccagaacgagccaagggaaggccgagatatccccagggtacctcttctcagcagcacaaagaggagtttattttcaaagacagtggaagctggaaaagataaaagccttgaaattgaaatgcaaacaggagagccctgccagaacaaggctgtgtgtctttcaaaccccatctgagaaagagaggctacctccacagagctgcgtcagggcagggtctggtcacctcctgggacaaacaggaggaagctcgcatggggaccaccacctagagtggcagcccaggcctgggtccccgccaccgaagggtccgcagagcactcctgggcatcctcaggtgcatgccaagatttcagaaagcgttacagaagtgacgcatccttcactacagccaagatacggaaataatgtaactgtctgttgatggacaaatagataaagaaaattgatgtatttacacaatggaatactttttggccatgaagaagaaggaaagtctcccatttgtgccaacctcgatgaacccagaggacaggatgctaaatgaaatgacccaggcacaaaaagatgcatatcacatggtcttccttatacatggaactgaaaaaagctgaactcacagaagcagggggtagactggtggttgccaggtgctgggagaaatggggagatgttgtcaaagcatgcaaacctccagttgtaagctggtaagttctggggatctagcatggtgattatagctaatagtactgcagtgtttacttgagacttgctgagagggtggacagtaagtgtcctcaccacacacatgcagagggtaaccatgctgggtgatggatgtgttcattagcttgactcagtagttatcccgtcacaatgtctatgtctattgaatcatcacttgtacatcttgaacatacagtttctgtgtgtcaatcatacctcagtaagctgcgggggagtgacacattcaccactggccatcagtaagactggacaggaccaccaaggcagacataggggggctagaaacccaaaagtgcagatggtgaccctacttaccacatacagataacagagactagaagaacaatttgatcctcttcatgatgcactttttttggaagacaagtcttttcaaagagaaagatgacaataataacgaaaacgccccagaggacacaaatttggaactacgggcctcaaggaagccacaacacctggtattctcagcatttcttggtccctgacagacctctttgaccaactgcttcaaactgacactttctctttctgtcacctcagataaatcatttcaccgccctaaaatgcaggcttcttcatttgcagaatgagagagggagactctgtgcactccttctgtgcctcgcctgtttctcctagggatcctcaacacccttcagcttgtggacagcagcacacgaggacactgagcattctgtttgagtccctctagtggctgctgaatggcgtagtgactcatgtgggcttagcgagggcaggagctgtctcacgggagactgccccccacccgccttccacaaatgggggagaagcaggaggcagcagcaggcatgtgcgtggtctatcacggcccttttaaaaactgctgttacagaaaatgtcaaactgcacaggaatagagaggaggagcgtgaaccagcgtgtgcccatcagccagcttcagccactgtcccctctcagccaagcctccttccctcggcagctgcccatgctcacaccctttatgctccactcatattatttttgaatcaaaccacagacatattaccatttcatccgtgaatgtttcagtgtacatctctcaaagataggatgactcatttttataaatataactataataccattgtcacacctaaaaaacttcacaatttattatgttacatttacccactcatgtccctaaggagcggtcacacagctttcatgagtgaacacaacctcttctcattgggaacatgaggagggaaggggctgtgaacacctaaagtgagcagacacgctgaaccaaagcttggattttcttccgtgacaacagctgggtctctgcgctttgaacacactcgtgatcagcagaggaaagtcaagttcagcatgtctggcttcatacttgtggagaggaggtggggtaacaataatgatgataatgctattaatagcaaaggtggaggaattaataaatgaccactgtgccaggcgcaaaaa

SEQ ID NO: 41 - DNA, 2764 bp, Homo sapiens
  nbla21527
agtaaagaatctaaagtagtaaattttattaatatgacaagctgaaaaataattataagctttattactaatttgcttgaaaaagcaaacaatgaaatgactattgattatgatcttaagagatgagtattgttttttctctaggatttataaagatgcatcagagttcatctatagaaggacaggtagtgtttgggaagcatctataattctctttgtgaaacatcagtaagtctattgtagtttaagaaagtttcatattactattattttagtttttatctctaaaattctatgaaacattttgaagtataaaataaatatttttaaaagaaagagaacagaagtagcttaaatgatcatattttactcttaatgcacttttaactttctcaatactatatttctctctccatctggggtacggttaaaaaagagccttcctaacacctcaggagggaaagggcaacacagggcattggactccccatggaaatgaaagagtagcttcagcatttgtaggatgattaggatgagactgtggggttgactgaagaatcatcaattagagagggctggtaaaacaaacttctagaaagatttgggttaactttaaaccattgtaacaattatctaatcaacgtgatgtttttctagcgattaaaatcaagtggaaaaatataactatcaaatttcaaattatttcagagtcatgcatattgatcatcagcccatattttcaatctgctggtgcttgttttcaaccaagatttaccatggggctaaccatgatgtcacttgctattagttaacctctgtacttctttacttatagttgttttaaacaagcaaaagctcatagagtgatttaaattatattttaatgatggaaattccaagagctctttcacatactgtaattatctgccataaagaagagtaccccgttggtgctctgggcttgcatcccaacaccaccacttactggctgtgtaatcttgggcaaattatttaactctggttttcctttatctgtaacaagggcatgtaatagttctactcatttggttgttatgaggtttctgcgcattcatctacataaagtgctgagaatcagaccaagcacatagaagtaccatgaaagtgttcattatggatgacggtgatgtcggagtgacattgtatagttataagagttgctattatggctacataatatccttcacaatctttcaagtatttctaacaatgttgtgccaaaatatttgctaaacaaaacttaattcacttttgttgttgatgttgttgtatgtttctcgtgtcctgtgccactgagaagcaagtcaaaggaatggagccaagtaattgcttttaatggctcagagatgagataatggatccagtcaatgtaaccacaggcagtctaaagccagggtgtacaccacaggcgtgggtgccaatatcagtgctgagacagagatagaagggagagcgcaacaaatgtttaaacagcaggctcagcaaggctcaacagagaaacaaaatgtttctagaaattacaaaatcagagactccatcacttggcccatacatgtcaatagagtgtttgatttaattcagaaataatttccaactatgcttttctctgcaggttaatgctagtaagaactactccatggctaatttgttcttcagagtaaactgaactaatactttccaagtgcaagctgcctcaagttgataaatgcctaaatttccaaaatactacaaccaaaagcaaagttttccagttctccagatacaatttttttatagatacctcaacatgcacaaaacttttctttgttgctgttgttttttgagacagggtctcgctctgtcacccgggccagagtgtaatgatgtgaacacagctcactgcagcctcaacctcctgggctcaagcagtcctccagcctcagcccccaactagctggtactacaggcctgcaccactattcctagccaatttttgtattttttatagagacggggtcttactgtgttgcccaggctggtgttgaactcctgggttcaagcagtccaacttccttggtctcccaaagtgctaggaatacaggcatgaccaccatgcctggccacagaaaactcttatataaaaatttccaacaagtatgaaagagtgtttaaatactctctaactcttcatttactatttaaaataacaaaattgtaacttgaaagttggataaaaaaactcaaatgagaaataatgtctcaacaaccgtttcttactatgaaagaaaattcaatatgatcttttcacaccatataagaccttattttgcccttgtttataacccactttctttggggggccacatgaataaacatatttgacatatatccatagtctgaattaggacatttctattcttgcttgaagaatttgatgtttagaaaaatttctcagcactggccaggcacggtggctcatgcctgtaatcccagcactttaggaggccgaggcaggcagatcagctgaggtcaggagtttgagaccagcccaaccaacatggagaaaccctgtctctactaaaaatacaaaattagccaggcatggtggcacatgcctgtaatcccagctactcaggaggctgaggcaggagaatcgcttgaacccaggaggcagaggttgcagtgagccgagttcgtgccattgcactctagcttgggcaagaagagtgaaactccatctcaaaaa

SEQ ID NO: 42 - DNA, 2141 bp, Homo sapiens
  nbla21551
catatgaaaaaaccaaagtgctttatttaatcacccggtctgcggattgtgttgaatcaaggtgtcagtgattctaggtggttctgtctccccctaaactgagacagagcagatacttcaggaaaacgtggaagttggtccgtacttctacaatcctactggcccagcctgacccccatgtgacagctttgagagttttcatgcagttagagacaaacacaggtcaatgacaacaactacagcatgtgatgtgtgctttatgatctaagcactttcagagcctttcaaaaactcagggtctgtgtgtctgggcactgtgaacttgaaagaaagccttcaccctgtccctgataaccttgtgttgtcctcagatgagcccatgtctaaagctcccatggccaaagacagttaccagcttctcacctagccggtcacctctgtctaacttggtatgatcactgacaactttggccaattaatgaagaggtggcctcaaattgttcaggaactcgaaaagcacatgtctgaaggggctaattgtagtgataggaaactataaaagtaaggatgttggattagaagttagctgatcatcaggagatcaagaccagcttggccaacatggtaaaactccatctctactaaacatacaaaaattagctgggtgtggtggtgtgcacctgtagtcccagctactcaggaggctgaggcaggagaatggcttgaacctggaaggtggaggttgcagtgagccgagatctcaccactgcactccagcctgggtgacagagcaagactccgtctccaggaaaaaaaaaagaagaaatcagttgactgtactacctttactctcaatccagggtcctatattctagtcccacctacttatgtcttgctgtgggaccaccaggaagtcttagcttcttagggcccagggacttttcactgctaagtttaagtaacttgattcggatccgttgtggttcccacagccttcaaatactgtggaagttttaatttaaatcttcagataaactcttaatttttgagaactccttgatttaaataaaacatgtcggctgggcgcgttggctcacacctgtaatcccagcattttgggaggccaaagcgggcggatgaggtcaagagattgagatcagcctggccaacatggtgaaaccccgtttctactaaaattacaaaaattagctgggcatggtggcgcgcacctgtagtctcagctactcaggaggctgaggcaggagaattgcttgaacccggaagccagagcttgcagtgagccaagatcgtgccactgcactccagcctcgtgacagagtgagaccccatctcaaaaaaaaaaaaaaaaagaggatgagtttcttacctagcacaagattaatttttcgtatgtgagaaaaatgtaccttcatagatttccaaacagaattatggcttttgaacatacaggtactaaaatttaaaaaggatttcatttttctcaatttggattagatatactgattgctctcagggcgaaacgaattttaatttagttcttctttttcttaagtgggagtaagcttttctacctaatttaaaaaatgagaagacatttaatttacgctttctccttcactcaaagatactaataaccatactatttaaattctaaatcccttctttaaagaacttcaaaaccaaggaggaaattaaaatattttaattcatttcctgatctcactcatcataatagaaaaagattcttagattcagacaagaaagatacaaaccttaggagaatttccacagtttatttccaaattttaggaaacttgatcctggaatgttccttcattcttcacctataatttgtaacaatgtgaagtcacacttgttccataaatcctgctcaaaccactctagtccctagtaatctctctgtccctccaaattcaaacaataaatgtagcccaaacctttcatttcccaaaccaaacagcatagatcttctaaactgacatttgtctatagtgaagaactagttcctcccctctccctcccaattcattgcagaccaatacttttgttaaagaaggaaataatcaaaatgagttaccagaagaatgaaacaggaaaaa

SEQ ID NO: 43 - DNA, 2761 bp, Homo sapiens
  nbla21735
tagctggcggcttccgagcgcctcttccaaagatggtcagaggggccggaggcgtccccgctcccgctcgctactagcccgcgggccagcgccgcgtcccgagccccggcgggagccatggctctaaaaggacaagaagattatatttatcttttcaaggattcaacacatccagtggattttctggatgcattcagaacattttacttggatggattatttactgatattactcttcagtgtccttcaggcataattttccattgtcaccgagccgttttagctgcttgcagcaattattttaaggcaatgttcacagctgacatgaaagaaaaatttaaaaataaaataaaactctctggcatccaccatgatattctggaaggccttgtaaattatgcatacacttcccaaattgaaataactaaaagaaatgttcaaagcctgcttgaggcagcggatctgctacagttcctttcagtaaagaaggcttgtgagcggtttttggtaaggcacttggatattgataattgtattggaatgcactcctttgcagaatttcatgtgtgtccagaactagagaaggaatctcgaagaattctatgttcaaagtttaaggaagtgtggcaacaagaagaatttctggaaatcagccttgaaaagtttctctttatcttgtccagaaagaatctcagtgtttggaaagaagaagctatcatagagccagttattaagtggactgctcatgatgtagaaaatcgaattgaatgcctctataatctactgagctatatcaacattgatatagatccagtgtacttaaaaacagccttaggccttcaaagaagctgcctgctcaccgaaaataagatccgctccctaatatacaatgccttgaatcccatgcataaagagatttcccagaggtccacagccacaatgtatataattggaggctattactgcatcctttatcagaggttcacatatgggatcctttgacaaatgtttggattcagggagcagaaataccagattataccagggagagctatggtgttacatgtttaggacccaacatttatgtaactgggggctacaggacggataacatagaagctcttgacacagtgtggatctataacagtgaaagtgatgaatggacagaaggtttgccaatgctcaatgccaggtattaccactgtgcagtcaccttgggtggctgtgtctatgctttaggtggttacagaaaaggggctccagcagaagaggctgagttctatgatcctttaaaagagaaatggattcctattgcaaacatgattaaaggtgtgggaaatgctactgcctgtgtcttacatgatgttatctacgtcattggtggccactgtggctacagaggaagctgcacctatgacaaagttcagagctacaattccgatatcaacgaatggagcctcatcacctccagtccacatccagaatatggattgtgctcagttccgtttgaaaataagctctatctagtcggtggacaaactacaatcacagaatgctatgaccctgaacaaaatgaatggagagagatagctcccatgatggaaaggaggatggagtgcggtgccgtcatcatgaatggatgtatttatgtcactggaggatactcctactcaaagggaacgtatcttcagagcattgagaaatatgatccagatcttaataagtgggaaatagtgggtaatcttcccagtgccatgcggtctcatgggtgtgtttgtgtgtataatgtctaattgaatctgcagaaatgaccaagcaatcacttttttggagtatagttttataaaaaaagaatgcagggtttgaagttccttacctgataattgtgtctggcacatgataggggatcagtaaattgtaattcctaaccctactgtactcccaaacatggtgattcatggtcaagaaaaatcttatatatatgtatacacacacatatatatgtgttcatatatatgtatacatatatgtgtatatatacgcatgtatgtatacatatatgtgtatatatacgcatgtatgtatacatatatgtgtatatatacgtatgtatgtatacatatatgtgtatatatacgtatgtatgtatacatatatgtgtatatatacgtatgtatgtatacatatatgtgtatatatacgtatgtatgtatacatatatgtgtatatatacgtatgtatgtatacatatatgtgtatatatacgtgtgtatgtatacatatatgtgtatatatacgtgtgtatgtatacatatatgtgtatatatgcgtgtgtatgtatacatatatgtgtatatatacgtgtgtatgtatacatatatgtgtatatatacgtgtgtatatatatacacatatatacgtatatatgtatatatatatacacagttgaatcagtgggattaatacctataatctctggttttcaaaggtaatatggaatatttgacacttggtaaaaggtgaactacctttgtagtgaatcttttcctcttggtagcatcaacactggggataaatcagaaccattctgtggaatgaaatgtttctcaagagcctataatatagtagatagtgcatattaagatgtctggctgggcatggtggctcatgcctgtagtcccagcactttgggaggctgaggcgggaggatcacttgagcctagaagttggagactaacctggcgagaccctgtctcaaaaa

SEQ ID NO: 44 - DNA, 3851 bp, Homo sapiens
  nbla22247
aatttaatttacaggcttgactacctcagcagtttcactaagttctggtacataaatggatgttttattaaagaagaaaaggaagggggaagggaaggaggaggaagacgaagaagaagaaaagaagagaaggaaaggaggtgggaaggagaattcgtctttttctgctcaatattatgtcagtgaaaccaaataatgtgtctcggttcctccccctgagcattccacccgggtaaaaaaggaactaagctcacctctgctgagagaagctgtgcatggcgagtggcccccacacacctggctggatgacatctgagggctcggaggtccctgctgctcagtgtgccaggatggtcccaccgtcctcacattcacatttttttatggatgatgcgtcattctgctaaggcagcaaaagtgaaaacaatcaatagttctacccaaatacctgttattttaagaatggggccagagtgatttcttggctatgagcagctcaggagacactatttttcgttgtttaaatacaattgattttccttgcttcagaacccagatcactcacggagctcctggtgtgtcgagcttggatgaatttgtaatatgacacagtgatacctgtttgtttaaggacaccttgtgtgtaatgtcagtgttgcattactctgtggttccaaaacttcaagtccacactggagaaggtgggggcagcctgtggacagaggcaggaaagaagggacattgttttgagtgcctgttagcttgtaggcacagttccatgctcttttctgtaaaacaggccaatgatattggaagccaagtttgtctggctatggagcccctgtttctccactctaccaataatcaaaactcacagtgagaggttaaaccaatacatgcacacattaccaaaacaaggtttcacaaacaatatttacctttacacaggcaatttactcttattttaccagtcctactccataataattcaattctttaaaattatggttgcaaccccactaaattggcctcataatctaccattgtaacatggcccactgtttgatacacactggagtacaccttggtacccttcacatttttaaatgatgctatattggacttggtatccatgtgatgatcaagattgtatttgaagatgttgcatagaaagtcccatcctatgattcagttttttcatctaagaattagaaattataacatttattccccaaaattctccagttgaattcactggaggtattcattgcctctcagagagtctgttacttaaaataaagacaattaaaattaagatagcaagtattttagcaacaaaagccacaaaaaagaataataattataattgctattgttagtaataattgttgaactcacaacctgccggccactgctctatgagctttcaatataactcattcagttctcactatcactttatgaagtaggtaaatattactttcactttacagccagaattcctttatcttctttctcataaatttctcattctaaactgttaatatacatctcagaaaatgaatgagattgtgactatgactcaagaaatacgtatttctatgcttggtttaaataaaatacaaaagcctgtatcatctaattggcttgataaatctcactagctttttaataatcatgaaatttaaatttttttgtagaaaactttcagaatacttaatgaaaaatcagtatgtattcaccttcaaaaaacacaaatttccaggcataataataatatctgcaagtccaaatgtaatcacggtgccagggctggttgattcagcagcttatcactgtcactggggactcagattctctccacctttccactctcccatccctcatcagctttgtcctatgagggctgcacagatccaggtgtcacatccagcatcatagtgacaagaacaaaggtctctttctcaggagtctactaagtgtcccttaaatcctgattagcaaatttcctttgctaaaaatgagttatatgccaattcctaaactagtcactgttagggtgtagaatcactgtgattggattagaaaagctctgcctcctggaactaggaatgatgttgtttgccctgaagcacatggatctgtggtcaggaagaggggtcttgcgggaaatatatatactgagtaagcagtgtctgatacaaagacgaaaaatatttcttttgacaggaagatttggtaaaatataaagtagtagaattatttcccattatttaatctgtttaatgtttcataaaaattagcaaacgtaatgaggaaacgtatctgtaagaatccactatgcatttgctgtttgctctgaaatcaacaggacccagtgctttcattactagaaagaagaaaattaggtaggttaataaaacaaacatctggaaagtatcaacactcataaaaataaatggaatcatcctgtgtatacactaaagccaggttggcatttgtcaacaactacagagaaaacactacagaatttactacttccaacttcctgggtgggtttgttctcattcatttaacatattttcctaagtgaaaatttagttttaggttttgaaatacaatcatataagaatatgtagactaatagtgtttattaatttttaataatgcctacagtttcccatatttggttgcatttttcctgctatcctattgcttctgagccacctgttcccctctcaaaaacatgcaagctgggatttttttcttttcttttaactagatatcttgccaaaatttcagactcatagtaaagagtttttatttttcaccaacctaattattaaaaaaggagtatttagaatagctctaagaattctcatacagccttcatcctcattccccaaatgttaacattttactacatttgctgtatctatctctttgtgtgtatatgcacagacatacacagaatgtctatgccttatatacacatgtatatctctgtgtatatatgtatgtatatatgcacatatttttaatagattctgagttttctaatcctttgagaataagttacagtcatgaaacccctttatttttaaatacttgtgtatctttctaataaagaagaaattccccaatgaaacaacaaaagattaccaaaatcagaaaactagcattgctataatactcttatctaatttatagactttattcagatttcaatactatttttatggtcaaaaaaaatcaaatgtcatgggtcatgccctgaattcagctgtcatttctctttagtcttctttattctgacagtcctttagtgttttcctggcagaatgctgttaatatcagtcttcagtaaaacatattaagagaggaaacatcatgccaaagccagtggatttgtatggatggtggcttgagtgggattcgtcctgcctttgcagccttcctcctgcagggataataggtgtgagtacgtttcactattctcttagacatcctgacctgtaccacaaatgtgaagggccaactggagaactaggtgatccaacagtttgttattaatcatctcatctcttgccaatgaatagcaacaagaacatcccaaaacatctgaaatatttctaaatattctaaacatttgtaaaaatgtgggacattatagaaaaaaacttacaaaaacatttgtttcaatcactgcatgcttagatgcaatctttaaaagtacttcaagtaaataattagaatggggatgtttagaattggttaaaggttcattatttctgaaccaatgtgcagaatttggcttatgagtacaagaataaagacatttggatcaaaaa

SEQ ID NO: 45 - DNA, 1863 bp, Homo sapiens
  nbla22477
agctgcaggctccgagctggtttattctgcggccgaggattacatttatgcacgaacgggcttactggttccagattccccacttgggcacaggcataggaggcttgttttccaaattgctggttttaattgcacctgcctttcagattacctctgggaatctgtgggaggagccgagagggtggaaaatgtttcttagctttgcaaaaggaagaaaactttgtcacccagcgggagacctcagccacgagtaacccggggagacaccagaaccgggacgggctttgactgatttgcctacgagggttccgtaggaaaggacgcttgaattcggcgcttcggcggcggcggcggccgcgcgagttccctgctcaccctccctctccgcggaagtccccacgaggtggcttcagggtgtaacagagcgcgcggctccagtccgaaggcagcggccgggggagggaaggaggggaccgaacccccgaggagttttgcagaatcaacttctggttagagttatgggaagcgcggttatggacaccaagaagaaaaaagatgtttccagccccggcgggagcggcggcaagaaaaatgccagccagaagaggcgttcgctgcgcgtgcacattccggacctgagctccttcgccatgccgctcctggacggagacctggagggttccggaaagcattcctctcgaaaggtggacagccccttcggcccgggcagcccctccaaagggttcttctccagaggcccccagccccggccctccagccccatgtctgcacctgtgaggcccaagaccagccccggctctcccaaaaccgtgttcccgttctcctaccaggagtccccgccacgctcccctcgacgcatgagcttcagtgggatcttccgctcctcctccaaagagtcttcccccaactccaaccctgctacctcgcccgggggcatcaggtttttctcccgctccagaaaaagtaagaccttgatgctattgtttcagcctccggcctctcctcctctccgtcaacacccacccaagtgaccaagcagcacacgtttcccctggaatcctataagcacgagcctgaacggttagagaatcgcatctatgcctcgtcttcccccccggaacagggcagaggttctgcccgtcttccttccagagcccgaccaggcctccactggcatcaccgacacactatgctccctccaaagccgcggcgctggcggcggccctgggacccgcggaagccggcatgctggagaagctggagttcgaggacgaagcagtagaagactcagaaagtggtgtttacatgcgattcatgaggtcacacaagtgttatgacatcgttccaaccagttcaaagcttgttgtctttgatactacattacaagttaaaaaggccttctttgctttggtagccaacggtgtccgagcagcgccactgcgggagagtaaaaaacaaagttttgtaggtaagcagtgtgggcctgaggaaaatcgaaaatggaaaccttgaaagcagaaagcctaaagtattttaatagatgccggtttggaattcaacctagtaaacatgtttccaagttaaagaacattcttgctggcagggtgcagtggcccatgcccgtaatctcagcactttgggaggccaaggcagggagatcgcttgagcccagcagttcgaggccagcctgggcaacatagcaagacctcatctctacaaaaacatgcaaaaattagctactcaggaggctgaggtgggaggatcacttgagcccaggaggtcaaggccatgatcgctgcactgtactccagcctgggtgacagagcgagaccctgtcaaaaa

SEQ ID NO: 46 - DNA, 2680 bp, Homo sapiens
  nbla22639
agacggacaacttgagaaaagcagtcaagttccaaggaactgacagcaacctgcaaagaggaaaacagcatctcctcacctgcgtaaaattgtctcagcttctgttgtttctcaactgaggttcgtaaacccatcaggataatccctggagggaatagatccttgcacatccagggcaagaaacatgtccaagttacccagaccattgataacagttgcatttaggttgcacctgggtaatctggcataaaagatctctctaggcctcactgttgcggtgtctatcccttcacctccattgaaatcagcattttggatctaggtcttcatggaatccttgagaagagaggcctttacaattacccagttctgagggttcaggttcacgaaaagaaatgcaacttgggataatcatgaacaggttaaagataagatttcaagaagccatctaagaatacagaaccaaattggatccatttttttaaaaaaatggttttgcatggaacctggaccaaggcaaatgtcttttcttcgcagaattgttttccaggatgccagtggattcagatagcaatgcttggagtagaatccgttactaaaatagtttcaaagttgacaaaaaattttcaaagataaaagcagttttacattgggggttgctgaggtaggcacaagaaaaagtcaggcataaagcacaaggcagactgtttgagtggattggttgctgctcactaaagttgttcccctgatctctaaatatggaggtcattaccaagaaatgctttggtatgaatgagagccagatctccactgtgtgagccagtgaattatggctaattcggctgttacagccactggttggctggattttaaaccataaaacttgaagattacctacaaaagtaacagtgtggctataagcctgagctttaatggatatacatcctcacagaaaagttggaaataaccaaaactgaagtcttaatttaccttcagtttaatctgtggatttgttcaaatactaaagatcctcaggtccagaattccagcatcatttattcttttaaaatttttaagaacttgatccattgtatcagtacctcacaatcagagttggcaaatgatggatgagtgattcaagcagtgcacccggtggaagctgaaatccatctgtgaatggaactgaagtgaacgtgaatatgctgactatatcctggaagcatttttataccatcttgaaatttcaacaaactggcttttgccagttaatccagctgtctttcaagaataaaagttggggttttcaaggatcgcctcttctatattttaaatggattttcagtagaaatgatttttactaatcaagttaatcccaccccatcaaaaggtattcctagaaatgtcatagacctaggtaactttgaattgaatgggagctaacgttctttccaaagttttcaggtattctttgtgtgacaccttctcaaccaggaggcaagtaaccccgcctccacaatcttagtattttttttaaactgcatgcctgccccttatttgagctgcctttttaatttattgcatatcctttttattatcttattttggtattattcaatctatacaatctttttgtatttattgggaaatgagtaatatacaaaaaggttttcatgtatttgtggctgagagggcgggaaataattgtgtacataaaattaggcttttttaaaaaaaatagattatgatgcagaatattgttgatcttagattaaaaagtggaagagccacaaacattggtgcccttttcagactatttctctactctcatcatccacagtagaatttttaaacagatttttttaaagcttttcttttaaatttttctccgttgcaaagaatgtttcctaaattgtatgggagcaatagtatttttgatgttttaatgacatccgtatacttgtactgtattttgtactacaaggcagctgtttttcaataatgtcctgctgtatttacctacgtgttttgagtgtctatttctttgctgcggagaacaaattcctaaatagttttagtaaaggagctgagaagctagcattaggtttgcagaaactatttaagtttcaactctgaggcagcaatgaaaatttaagttgcagctattagttgattgctgtaactttttcattttcaaaccatgtacaattcttgtatagaccaacttgttttcttgcttcagtggtggttctgttgctcagctgcagtgagccagttcaattttgcaaaggtgcagtacctctcctttttaaggggttggtttattcttttttctttttgtttggctgaattgcagtaactagccttgcctttctattctgtagaaatgacagggtcttcacaatccttcaccagtggctactaagctataattagctgaatagaaagaatgtggaagtggtctgaggcatatagagtatatgccaagaacactaccatatatggcatcagctttggttaccagagaaattttcttagtcattagaccatgtaacagtaatatatcatatgtaaatctttagatatcaatttgaaaatcctccaaaaaaaggagcaaagaatgcataagctatgtgttggcaaaagtaatttatattaaaattttgacctgcctatgtaaaaa

SEQ ID NO: 47 - DNA, 1755 bp, Homo sapiens
  nbla23174
atataaatggagggatcaccaaaacaaagattatctctttggtagctatttaacctgaaagcgtaggagtctttccattatagaagcccctccgttccaaggaactagcgatggggctaggtcaatcagcagagttgacaacagggcttctttttgtgcaccagcattccccttcagagagcataagatcctgccagtgtgccaagtttgcagctgaccaaacttctaggttgtactggaattattctatgcaacactgatccttatatgaatgcgtttcttctgaatgatgttgactacccttcttacaacaaaactgtttcttttttattgcaaatagggctcttggtgttttttacttttttgtacatatcacagtacatggtttttcactctttagtttatttcattttattggaattaactttttttattctaatactgacagagtttgtaatctctatataatacgtaattactccaattacagcacttttaccttgaagagcatctcagtttttcccacaatttcattgagtcatcagagactgatgttgcttcttggtttcaaatttggtcctaaagaaactttcggctgtagaaacaaaagcacagagtgaattttttacaaaagacagggaatatagaatagtcattacagacacaaataaccctagtagcacgaagttggtgttttctctgtttttacttaagattaagaagatttttggtgactctgaactctttatttatatttcagtttaaaatatcaagactaaggggcatcagttatctttactctttaatattgcccatattttaataaattacactaattaaacgcatattttcagcataccagtggaattaattttgtggatcacacacatttaaatagtcatattgtgggaatattatagctggtaaccagctgatattgattcttattataggaatgactgtaatgatagtggtggtagcagtagtgatattagcggtggtggtgatgtgaagtaaaataaaagtatatattatattgtgcccaatttattagaaattatttgatcaatgcttcatttcattaaaatatcataaagatgtttatagtatttttttactttattatttaaatcataactaacaatatttttaaaaacttattttcattgctacaatgtcaaatattccaaaatcagccaactacagctatatatgtgttatgtgtgacagaagtgatcttccttccctctttttgagcttgacatgaaagtgaaagaagactcaatgaataattatgagctatttatttaataattacttgccttgggtgtaatacagtaatgaatgagtgaaacaaatattctcattgaatatgatacaatgctgttttctgtatgtttcatgttctattattaaaggtatccattaggccaaaattatttaatcaaattctttatctgataggtagattgagagcattttcttaatgcattaccttgtacataagtatacacttggtaaagtagacgaagttgaaatattaatttcatttggcatttagcatgtgaatatgattattgtttgattgtgtctgtatatttgtttggtgacgtgctcaggtgctcccactactgattaatgtgtgtgctaatatcctaaaaacacatatgaggtttaagaaaaaattttcttgtctgaaaacataaacatcttaataaaactgattttgaaataaaaactaaagtacttgaaaaa

SEQ ID NO: 48 - DNA, 1409 bp, Homo sapiens
  nbla23198
caatgtagcagttattgatagagaaattgagaaaactgaaacgtgaccggagtattggaaataacgtagtacatcacctagcacaatgacacatagtaggtgctcaataaatttatgcttataatttttgtcacttctatggcaggatttttttattaggttaaaattatcttttaaacaccttccggaattttagaatattcattaataatgtcttcaaacctttcaactgaaataaatttacagctgaagtctgatgatttaaagttagaaagtttaatcttgaatataaatgaacattttctctcccacattttcttgggcattttgagaagtaaatgcgttatttattggtccatgaaatgtgactgtaaatattctttgctatacattatgtctatatatctgcattcatcctcaatgccaaaactagaatcattagtcttaatgatcattttaagtacaggcagtcctcgctttccttgataccatgttaaccgaaacttgtgtatgtcaacacggtgtccttgctttgcttggttaagtgtgagttcttcctccctttttttaagagttgtacaacgtttttcagtcgcctaccgaatcaggtcatagactatggaattgaccccaccccaccaacatttttacagctaccctgatttctgaccagaaaggaaaaaaaaactttccagctctatcacacattttacctactcttaaacttaggaggtattacaaatagcattttctcatgttctctttctggcctgtacctccctgctaagcttccttcagtgttcatcctcacctcatagagagatgaagtgaagagacaaacagaagtcattttcttccttactttagtggtttctggtttagttagtttgggccaaactgtggacaagtaccttttcaggtaacttttttttcttatttctatgtcctcaacacctagtggagtacgtagccaatagtagatgcttaataaacatttcttaaattaatattgttgaccttttctgaccctgttcttgacagtaaggtacataatctgccttcatccctttagtccttaggaacagataaagtcatggatatgaaagtgatcactgtcattaatatccacattaaaattgctcttgattttagtttctccataatcattttccctaaacaatgaactctgttcacctttttttttaaaatatgcacagtgaatattactggtagcccaaatcttctaacataaaatttccattttgtaaaagcttctgataagcatatatgttatgaattgaatgtttgattattatactttaatattcttgaaaatattgatacctggactggaaagaaaacagacaaaagtaaatctcagaataaattactgctttaaacatgaaaaa

SEQ ID NO: 49 - DNA, 2433 bp, Homo sapiens
  nbla23328
tgtttctttttttatttaaaattgtcattgtttggtttaaatttttcagctagatgaaaagagtatgaactactttggaaaacttaacagctcagagatggccatgcctccagcccctcacgtcatctttgcaacagacgactgggctgccatggtccacccctcagcccgggtcccgggtctggatggaacgggagcactgctggtgcccactggcgtgtgtgccccgggtccctgtaagtgccccctcaccagcagcagcgtgacacacacaagactcaagaccaccctgtcagtgccccccagtgcacggcaaacgggcaggtgccgttcccccagtgacctgagggtaggggacaactgagcagtatctgaccagtgccacccaggagccagtctcctggccacatgcagaaagtgtggcccctgcttacctagatgttttgtgcacctccatgggcagagggtgtggatattgcctggattctgtgctgtcagcgttgctgagtatggccccaggagaccaaggagagttttgtataggctggaaaaccccttttcagtctttccaaaattagagggtatggcaagtttccttttttctctcctcccttccttcccctccttcctttcctttacccctcctttccttccttcctcccttcctctcttctttcctccctccctccctccttccctcccttccttcctctctttcctccttccttccctcccttctttccctccctcccttcctctctcccctattccttcttccttttctcctcctttttctgagtggagggggaaatattctaaaccaaaaatcctagatgctctgcccaaagccacttctgcatgagaatcgcaacccacagttccccggatgagactcgccacagtggacagtgccacctccttcccctcggccccggagagggcgaagtgggcgggaagccaggatgtgagcactggaatttcttggaagagaagcgataaatggagaccatggccagcgctgctttctgtgcactctgatgactgctctctgcagccatgaggatgtggctttacatgccagggagagtgttgagacgtcttaggttgaggatgagcagattcgagatatgtttgttgctctcgggttttcgatacaacatcatgacacttctgtttcaagctcatgttttccgtctcccctccactcttagtaaaccttgatctgtacggagcggcctgtccgaggctacgccggcctcctggctgctgctggactgtgcttaggacagcgcccatgcctcggagggactctgtcccatgagaaccacctgtgcaaaggaacagagctggatgtttccaggtagattttggcctcccagagcaatgcggcatttgagaagcaacagttcctaactccttatcttcagggaaggaaaagaaaatcacagcctaggaagatggaggttggattttaatctcggttttaaaaagaggacaaacaaaatgtctctaagccaggctagatggaatgtgctcccgctctctcctgccgtgctgaaagtcatgccttgcggatgcctcatgacagcagtggctgagtctccccacccacccccaacgtggctcatttcagattgcttcggccccaccctgcaaggatgtggtcacggagtggccaggaggctccgtctgagccacagggatgggtgtgcagagctccctcctcctggggtgccagggcagagattccaggcaggtgagcccagagagagctgccaggccacaccccctcggcctcctgcacggccaccttctgggtgaatcggtccagcccaagcccctctccccagcctcgccttcagcctctctcccagcctgcttttataaggcgcacttcactcaatgctgtagccaaaaaacgaggggccccagggagaggggacccagatggccacacacggaacgcgcctccacagccccgggaggtggctcactctgtacaggtcttcggaggccgtgtttgtatctaactgtgactgggctgaagcatgatgttgcctaatggttcgtagcatggtttttatttcttacgcattcttggcacacagtgtagctatcctcctgacgagcaacccgtctgcgtacctaagtgtggctccccgtgggtcagcgtcctggtagcatggatccagtctgaaaggtgaggacaacgtggaaactcatgagctgagcctgcccgctgggacacgtctccttcccgcgtcaccttctggtttagggagccgtcaggtccctaaacgttccctacaactttttctgaaattgtgcagaaaaacagatctcattaaaagaaaaaaagaaacaacttgtaggaagacagagaggtgctatgggtacaatttttaataaaaacattattttgttccttaaaaa

SEQ ID NO: 50 - DNA, 2201 bp, Homo sapiens
  nbla23420
ggcgctgcctcgtctctgctacccctggttgggcggccctgcgaagcagctccttcgggcagccccgggtcgcttagcggccaaggaggcttcagttctttgccgcctgcaaggcggagaccagaaggcggaatccacagctggcgacgcgggagcatctgctgtccaccagcggagcacaggccatcaaagccgcatctgaacttgaattctgtgcagctgattgcagagctggacccggatctgcgaccccctgtggacagaggttgaccgtaccccggagaggagctttctcacggagggcactggttgcagaggctggaagtgaaataaagacgcgctcttgtttcagagttcgtcccctgctgagataggaaggcagagccacctcctctcctctcccacctgcagattaagcttttctaaaaagcctaggcatcttcttatattcagataccctatcgtcgtcagtcatggctagcatcattgcacgtgtcggtaacagccggcggctgaatgcacccttgccgccttgggcccattccatgctgaggtccctggggagaagtctcggtcctataatggccagcatggcagacagaaacatgaagttgttctcggggagggtggtgccagcccaaggggaagaaacctttgaaaactggctgacccaagtcaatggcgtcctgccagattggaatatgtctgaggaggaaaagctcaagcgcttgatgaaaacccttaggggccctgcccgcgaggtcatgcgtgtgcttcaggcgaccaaccctaacctaagtgtggcagatttcttgcgagccatgaaattggtgtttggggagtctgaaagcagtgtgactgcccatggtaaattttttaacaccctacaagctcaaggggagaaagcctccctttatgtgatccgtttagaggtgcagctccagaacgctattcaggcaggcattatagctgagaaagatgcaaaccggactcgcttgcagcagctccttttaggcggtgagctgagtagggacctccgactcagacttaaggattttctcaggatgtatgcaaatgagcaggagcggcttcccaactttctggagttaatcagaatggtaagggaggaagaggattgggatgatgcttttattaaacggaagcgtccaaaaaggtctgagtcaatggtggagagggcagtcagccctgtggcatttcagggctccccaccgatagtgatcggcagtgctgactgcaatgtgatagagatagatgataccctcgacgactccgatgaggatgtgatcctggtggagtctcaggaccctccacttccatcctggggtgcccctcccctcagagacagggccagacctcaggatgaagtgctggtcattgattccccccacaattccagggctcagtttccttccaccagtggtggttctggctataagaataacggtcctggggagatgcgtagagccaggaagcgaaaacacacaatccgctgttcgtattgtggtgaggaaggccactcaaaagaaacctgtgacaacgagagtgacaaggcccaggtttttgagaatttgatcatcactctccaggagctgacccatactgagatggagaggtcaagagtggcccctggcgaatacaatgacttctctgagccactgtaagggaccacccccaggtttcagtgaacccttacctatattcagcatccagtagtgggaaaactggggtgggggtgggggtgggacttctaactgcatgaattaatccacaaagcggctatcttttggggtggagtagaaagggtcttggataccagcacattggagggagatagcctgacctctgtccttgctccttctccctgcagcctacgggtctgttttctgtgtgtgcccatttccttgacagctttattctttgtgaaagtggtataatttattgttaaatatttgaacaataaaaaaggtacaaaaagtgaagtacaaattacccaaatctctccacccttatataatcattgtcaaccctttgatgagtgatatttccctatacctatgtacccagatagatatatgcatagataaaagtgatgaaatataagtgctgttctatctgtattttttcaccaaacaatatatgttgtgagcttctatgtcaataaatatatatatcagcaaaaa

SEQ ID NO: 51 - DNA, 1806 bp, Homo sapiens
  nbla23483
tttgtaacttaaactttgaccaagaaattcttcacttctcacttcttcacttcttcccaatatacagtaagtacgtgagccagtcatccatacactaaggcctagttgagaaaaacctttgattcaggatggctgggttactaaccttgaaatgtaagagatctggttttgaatgtaaaagttgcaacacacaaacggaagtcttaaaaactttttgctctggtcagttacaggtggatccccaataatctgtttttggttttctgatggaaataatagaattaggggaaatcaaatctggttggtaggtgtctacagtattagaagagggtataagggcactgtttaacactaagttctaatacttccagaaactgtgcattccagatctacatactaaatgctcttatcattttgaaatgggctcttgattaatagacccatattttttagtggcttctatgttgtatatttgtctaaaatgaaagctcttttgcgttctaaaactacaatatatgtcatcttattttccctgagtatccaagtatagtgcagattctatgtaaaactactaaatgacactggaatatgtttagtagattagggggaaaaactataaaggtttatacaattgtttgtagttacatttaggatggacttatccctttggagaagagtgaagtttgttttttcgccatgtgatgaagaccactgtgattttttaaaaaagtagataatacttaaaatggcgtaataattctgcacttgaatttgtactgttaacagcacatttggaagattttaaaactttttattgtcttataaatagcattcacttattattttggatatttaagggttccattaagttaacactgtatttggacaaagtgtgaccaaattagccagtctgttttcttccatgtttaattagaagtgagaggtagaagtacttcaaattcaacaggccagcaagcaatcggcttaaaattccctttcttaaatgttgtgctcttatgttctcggctttttaatgactttatttttacagtacttgttcagtcacttgagatgaaatgcttggggtagcttttccatcctcaaacttaatgtttttactagttcatagtgtttggaacagtatatgccaatcactgagactgcatcagagtttgcaattttgtatgtttcattgccaaagaaggcttagtggttgttgactgtagtataagtcagctttctgtagcataagatttgattttcccatacttacttcacttgttatacatcactgattatttgggttaaactggactcatttcaagcagtttgcttttgttcaaatcgtgatgagaaacctaatactgtaatttgatttgagccataaaacacattttaatattagcttgtattatagttattaagcttgtttttgtggaaaaaaacttactaaaacctaggtaactctagattaggccagttcaggtgtattttgtatcttagtaatggatcatatcgtaaaaatagagataagttgggaagatatattgattatgctgttctgttgagggaaaggtcatgtatttagaaatttaaacttttggttattgtgttcacatcatagtattcaagcatcatttatagtttggttttgagaacttttctggtattacgtttatggcaaatgtataaaagaaacaagttttggttatatttttatatttgtaaagtaagtttggttaaagtgatcactgttctttttttattttattgtcatttcaataaaaaatatttgaaagagaaaaa

SEQ ID NO: 52 - DNA, 1659 bp, Homo sapiens
  nbla23808
aagacttgatgctgctaaggatctactatgtgccaggcactgctctgggcgctgggacctgcacctgggctttttcgtcatggtgcttttatagcctagtgggagagttggtgaagtagatagtgattcagtgagatgggtgttatgattggtcaggggtctgtgggagcaccaaggagacagacaagattgatgtgcacctactctgtgccaggcgtgtgccaggcattggggatgtagtggtagttaaacaccatttggtcttcaggagctttaattctagtgtgttgggtgcaggggggtggaatggggacagagagacacctaatccaccctgtggtggctttctggagagggaggcatctaagctgagctgtggctgggtggagtgtgggtggggatgagttccgggcagcgagagtggtggacaccagtttctggggatcagagaggatccaaagaggttctggaaggttcatgtggaatgtagcaagagataggagacatggacatggtgccgggtctggttgccaagaagtttagattttatccttaggccttggggagcgacggatatgatctgagaaagggagttagtggatttgagttttaggctggccatttggcttttccagcccaggtggaactcagaggagtttgcaatggcctctggccacattttagacaactgagcagaactttttgaaactaggaagaccctttggtccatcttttgataaacagaatccatacatgtctaccccagttggaagtatctctgcaatgactggaaagtaaagaggaccaaggtgaaaataaaggctcggaaggggagcaatcttgaaaacatgtcatcccatggtggtgggaagtccctggagaagatcaggggaaacacagtcataggctgcaagtctataagataattccattggggagggagcccatttgtcatgcatggctgcaaggggcagatacaagtgtggagtaagcttgcaagagctgatcctggtcccagagagggaaaaatatgccttggtgggtaatgaaccttttgttcccagaggcagaaggattgggactaggccaacatagagattggcgatggttgtgagattctaagagtgtgtgtgcatcttgacaatattagaggaggctgagcccaagcaggcacattctcttcgacccctccctcattcagtctgctttggagtctactgaacatcaagcttgctatgagcaggatcttagagctgaggaattggcctcccaatccgaacaggtgttataatcctttcttaataggttgtgctgtggacccaatgtgagggctgtgctggtgtaaatggtgacatgttgagctggggggatgctttcggggtggggggactggttccattccatcaaaggccctcttgagagtctatccagggacccattgttttactttaacagaccagaaaagatgtttgttttccatgtcattacccccaggggataccgaatgtgtgggtagaaatttctctgtagattaaaaatcagatttttacatggattcaacaaaggagcgtcacttggatttttgttttcatccatgaatgtagctgcttctgtgtaaaatgccattttgctattaaaaatcaattcacgctggaaaaa

SEQ ID NO: 53 - DNA, 1520 bp, Homo sapiens
  nbla23851
aattaccaaacaaaattatagtcttgtactctaagaagcagccatgtcttgagtgagaaggcttaggatatgaggactagatatcagcaaggataccataggtttggaaagacattttaatttacccttagaatacacaactttactgatttttaaggatgatcagcccatcatatagcactttattttttcttttaaagacaatcctgtctcatttaccttcacttgacacaggagtttgagaagtcctgggcaggtatacctggttattttgtcattggtagtctttttaacttttagaaaataatcctagtaaactaaacctgagcctctgaataagatgttgtctgcctttgtagctatatgagaagagtggcagaccacagcttttgacggggatttttgaataaaataactaaaaccaacaatacagcaaaagctcatctgggaaaaggacaaagagtaaactagtaaaatgtaaggctgtaaggaaaggggtagaagatcagaggaattctcatcaaaatattgcaaattatcccctgaacacaaactggtaacggtggtttgcttaagggaaggaaattcggagattagggatactgggtgaaaggcagattcttttttttaccatatattcctttgtatcttttaaattttgtattacattcatttgtgatctttcagaaataaataaataaaaatgcagtagcttcctgatcagaaagagggaataattgctgtcacttgcgtttcagaaacatagcatccaaactgatgtgattatggtgacctgtcccacttagttttgctgatgtactataattactttctccagtgaggctgacttcagaaacagttgcagatgcagaattttaatccagggtatgctgtatataagtaacttttgcatttacaatctaccatttggcgttttatggctaataatccacaaatatctaaactaatttataaaggcaaaaactactgatttaatgtagtactctgcttctgtatccccgaggtgagtcagaaaaatttcaagttgccacgccttggccagaccccacagtatattggttattggtcctgaagttagttctttaaaataacttgaaatgtttcatgcttagttctaggatctatactttctttgatttgactgggactgaaaggctcagaataactgaatatccttggctctaaataagaagctgtaactttgggccaggtgcagtgcctcatgcctttgggaggccaaggcaggaaggtagcttgaagtcaggaatttaagacagtctgggcaacatagtgagacccccatctctataaatgctttttaaaagtagcagggcatggtggcatgtgcctgcaatctcagctacttggatgggtgagttgggagcgtcgcttgagcccaggagttctgagctgcagtgagctgtggttgcactactgagctgtgattgcactcaaggctgggccacagagtgagaccctgtatttaaagaaaagaaaaa

SEQ ID NO: 54 - DNA, 2962 bp, Homo sapiens
  nbla24011
aagaacacttgtggatcaaggcgtgggtgtctttttctttttcatccacagtacaggtttcaaatggttgtatggaaagctttggataaccatacttagggaacattaaaaatggttttattttggttggctcaatggtgatccaaagagggggttgtggtagtggtttcaataaaacttcacaaccaatgggaatcttttttgagtttgtgtggagtgcccttaatgctggaaataatcctgttggctaggactccagaactgtacggatgagaaaaggatgcaggaaattctgttgtttacacatgtggctgcaactgagacactggagcagcccagcaagcccagagggtcttaaaaataaatatgaatttagattccatacatcgattaattgaggaaacacagatcttccagatgcaacaatcatcaattaagtcacgcggcgacatggtggcccctgcctcaccccccagggatacctgtaatacctgcttcccacttcatgggctacaatctcatgctgctcacaatttctgtgctcactcatataacaccaacaaatgggatatttgtgaagaacttcgcctgcgggagcttgaagaagtcaaggccagagctgctcagatggaaaagaccatgcggtggtggtcggactgcactgccaactggagagaaaaatggagtaaagttcgagctgaaaggaacagtgccagggaggaaggaagacaactcagaataaaactagagatggcgatgaaagaattgagtacactgaaaaagaaacagagtttgccacctcagaaggaggcattagaagctaatgttacccaggatctgaagcttcctggcttcgtagaagaatcctgtgaacatacagaccaatttcaattgagttcacaaatgcatgagtctatcagagagtatttggtaaaaagacaattttctacaaaggaggacacaaataataaggaacaaggtgtggttattgattctctaaaattaagtgaggagatgaagcccaatctagatggtgttgatttattcaacaatggtggttctggaaacggtgaaacgaaaactgggctgagactgaaagcaataaatctgcctttggaaaatgaagtaactgaaatttcagctttgcaggtgcatttggatgaattccaaaaaatcttatggaaggaaagagaaatgcgcacagctttggaaaaagaaatagagagactggagtcggctttgtctctgtggaagtggaagtatgaagaactgaaagaatcaaagccaaaaaatgtgaaagagtttgacattcttcttggtcaacataatgatgaaatgcaagaactgtcaggcaatataaaggaagaatccaaatctcaaaacagcaaagacagagtgatttgtgagttaagagcagagctagagagattgcaagctgaaaatacctcggagtgggacaagagggaaatacttgaaagagaaaagcagggactggagagagaaaatagaaggctgaagatccaggtgaaagaaatggaagagcttttggataagaaaaatagattaagtgcaaactctcaaagtcctgatttcaagatgtcacaaattgatctgcaagaaaaaaaccaggaattactgaaccttcaacatgcctactataaactaaacagacaataccaggcaaatattgcagaactgactcatgcaaacaaccgagtggatcaaaatgaagcagaagtaaagaaactaagattacgagtggaagaactaaagcagggactcaatcaaaaagaagatgagcttgatgattccctgaatcagatccgtaagctccagaggtctctggatgaagagaaagaaagaaatgaaaacttagagactgaactcaggcacttgcaaaactggtaattttttcacaaaatatgctgaattaaagattagggccttaaagacatttccatatccttttcttaaatatcagtaaaattgtttttattaactagaaatattaatgaaaaaaacgtagacaatacacaaattaatgggcttcttcacttcttctaatttttgcctaacagatactgcatattctcaaaaagacaatttaaatgtcatttaaaaacaactttaattctaagatgtgtaaatattttgaaagtcaaaaagggctttcagaatactttttacataaaatctgaaagagttataatatcggtaagaaaaagtaagttgaaaaccatacaagacgctgggtcattaataagaaaaccattgactttaagtataaagtactggtttgtttaaataattggtaaacttttatgtacgtgttgtctatgtggtggggatggcaggttgtattaacaaaaatgaatcattctagaggtgtaacaatacatttcttatataattttataagtcatttctaatctttgtataaaacagaagtgagcagatgaatcagaaaaaagtgttttgtattttaaagtaacagataaccagtgattgaatctaagacaggctgtaagcatcgctgagaaactaaaaggacttttgacttttatctggatagacatttctacagtaaaatcatggaaaggcatcagcattgcaaagtagcatctaggtagaaatcaggccaaaattaagctgtggtttccctctgagtagtgggaatagagaaaattaggaaattgtggttatgtgaatatttctttaaaacttttatgtacattatagtttattgcttcatatttaagtttagtttttaaggtaaaatgttattttgaacaaaaagacacttataattttccatacctattttcaactgaaggcaacttgtaagatttaactcagtcaataacatactggttttactcatctccccctccattgattagccaaaaaaaaaatgaaatcttactaattcattattgaataaagaccacttttatcagaaaaa

SEQ ID NO: 55 - DNA, 1360 bp, Homo sapiens
  nbla24235
tggcttaagacctcttttcctccttatctattgactggactgcggcaaatgcctgctaatcgttatttttgtgttcattcatttagcaagccaatttattacgcgcttagggtgctgccagggctacaaaagctgttgagactgtacttgatatgaagaagcttgctgattatcatgggaagactgacataaggaagcaccataaaattctgctgtatgagaggtatacacgggatactgggggttaataattgagggtatggtccattcaacatgagtgagacagaaacaattcataaaggagatgaaatgtcttgaggaatgagctcttagaagaatagttttcaaatgagtgtgcatcacagtcacctgtaagacttattaaaacagatcgctgggccctacacccagaggctgtggttcagtaggctgtagtaaaccagtaatttgtatttctatgacgttcccaggttctaatgctgttccccaaggccacaccttggaaaccaccacattaaaatacccagaaggcattaattcccagtccttcctctacacagctgcaaaacaatggtcctgaccatttcatctttgcactacatccttcactgtctctcttttgcccataggataagtacaaactagatctggttactgcctgccccaccagcctcagcatctctcacaactaggactaactttttcttctgacaactataaaatatttcccttgccttctcaagtttgctcaaggtcaagttatgccttttgcctggaatgacttgacttctcttttgttttacttagctggctgcttttcatcttgtaggttaggtcaaggactccaggaagtcttccctggacaagtaatgaagagggcataatccaagggccaactcccatgtttggaacctgactccattttcaggcacgtaatattgtcaaattccttttaaaagcacctgtctgtctgttaacgttggtgcagatactgctattcccctcctccataccattgctgatggttactgagggtatgggaagggccgactagtccagctgttcacaaacagcccttaatgtcaaactgaatactgccaacgtagttccagtttctgtatctaaagactcagcttggagtcacttgtctggactaaaagtaacccctccttgtctggtttgtgactttctgtactctgatgcccccagctttctgccttctagaaatttgtcagaatttccaaaattcttgggccttccttcttgctctatatatggttttggattcattccttttaaaaaatatttactgtcatttcagtagaattttgacacaataaatataagcacatcagaaaaa

SEQ ID NO: 56 - DNA, 2049 bp, Homo sapiens
  nbla24556
ggacaattaaggtgaaaattattctattttaaaggggtagagttcttgaggaagaacacctttgtgtgcatgtgtagtttattccttctacaaatatttattggacaacagtgttgcgacagtattctgtgcaggccactggagatacagtggtggaaaaaactaaacttgttcccagttttaatggaatttccagtctagattgggagataaacattaagaaagtaattccactagtgcagaattatgatacatattatgcaagaaagtatatatgctctgggggcttgtaatgaaggaacataagttggtctccaggatgctctctgaggagggggaaattgcaccgagcacaaaggatgggtaggaattaacagggtgaagatggaagggtgtagccagctcctgaggtatccagggcttttgccttttcacagatggcagtgggtgtataaatggactccattttttctttgtttctgactttttggctgcaatgccaagtggctgttttctgtctgtgtgttctgtctgtctcccagaatctccaaagtgttctgttcatggatggtatttaataaatggacattcactggtagaaagtatttgagagtctattagaagttaaatttgtttcaaggcaataaaattctaaggcatttaagagttttctctgtttaaatttttaaacaaattgtgtcttattttttaacatcctactaaataatgacattattaggcagctacttttagataaaatgtgataaataatactttcttcataaattctgctctaagaatctgtttatattttgatttaaaatagaaatcttttatgtaatttaaaacctcattttgaatggaagtgatatgaatagtttatgcaatttctgccaaggaattaatatggactttgtataaaccactgtcatttataatcaaaatgcttttaacttacattgatgttggcattaacaagtattgctagattggtagcatagaaggaaattgcatttagacttactaggagctcattgatgcctgaggttttataatgctttctttgggccatttaactgctggcaactttaattcacatgattcataatgctggaaattcaaattcactcttaactgaaaagtgaagttacttaaattctttaaatgctaacctttggaaaaatatctgaaaaataaaggcactgccaaaagattatcatttacataaatatctctttcagcagaagagtttaatgtattgagctcagaaggttagaatagagacttcaatctggaagccagcagtagcctgttggcttgtgaacagcagcattgttcatcatactgagaacactgttgcattcaggcagaagcagagctggcattaaaatgcagttaatttgtttcatgtgacttgtcagctgtgtgtttttatctaaatctttctagcttctctttttagtattttgtgttcaactcctgcaatagatgaactacctatttaactgtttaagctctgattttatcaccacttgcaaccattctccaggttttccatttcattttaaatatatttaataatcagtttgaacacgattttaatgtattaaaagtaaccccatctcagagggcttttctgtcttgtgcatgtgtctgtgtctgtaaaacggactttctgaagttaattaagataaaattgctacccttattttctccccagcaccctattctcttcttgtttgctaattgtgttctctgggtttttcccttagatgactttcaatatttggctactagccaagtattgggtctgagcagtaaagtgctagtcccaaagaaatgatataactgttactaacattagaataaggttcccatttcactttttgaagggcgtgaaaatcttactgctcctctgcaactgtgctcacttagtataatctaacagttaatattcttgtttaattggaaggatatatccagtgatttttaaacaacttttggaggtgtaattgacatacaataaactgccatatttaaattgaaaaa

SEQ ID NO: 57 - DNA, 1373 bp, Homo sapiens
  nbla24800
tgaatttggatattgatgaggctgaaatgggatagttcatacagggaccttggatttatactgttgcttttttatggccatgttaaaagcatctactttccccatgggaggaaggtgcatgctgagtgatcctgttgagctgtcactgctctgtcaggagattcttgttgatggacatatgtctgaccacttgagaattgtgttggagtgaaatacacttgcataagtcaattattaatgacagttcctttagcaactcccagagaaggtggggcatgacttcttccctggagctgacttcagacaaattcacagatgctaaaccctggctttttttttttttaacattttaatttcctctcatagaatcatcacaaaataagaaaacacttctttatatcgtaatcataattccagtgttttcagttttatttcctttttccactaaaatcattcctgtgtttcaatcagtaaagtgggcttcttgatttcatttgggatttgtatttgtgtttttgttttccattcgtttatgtttctttggttcgtagtgtcagaagacgatgttttttatgacaaactgccctcgtttgaaaggcgctgtgaaacgcctgcaggtatggtgctagccaagtgatctctagagacctagattccaaaaatccaagccattatccatctgaatgctataaacttcatggacatgccctcacctcatgagtgtccagtgcctctcagatgcaccctgtatatttactgttcatcgtggaactcgtgccactgaaaatttttaagtgactatattcaaaaacagcaggttgcatgacagtttctcagtgaagaggttcaaaaaaggtgagatgctattgctttgtgaatttacaaaggaaagaataatttaactgctcagaattacatgtccggtcactgctttttaatttaaaaaataatagagcatcattagtaatcttgttttctctttgatacataggtaaagggtgttttgtgtctggatgcctaaggtgattccaggggaggggatggaagatatgtgacatcttccctgaaatttatattgatatgcaatgctttgtcatttaaaacctaagctaatgttttctacaatccataactctgagtttatctttttggaaacatagaaggggatgacattgaagatgaaatggatacagcaattgctgaatgacagtttgcccaaattagtgcagttaaaatatgctgatgcccctgcatggccaggaagacttctgctccatgcacacaagcaccaagtatcaagcgaccaccaacacattcccattcctttaggcctccatagctttgcttttgctttctgtttcctgaactaaaaa

SEQ ID NO: 58 - DNA, 2192 bp, Homo sapiens
  nbla20001
ataataaaaataaaacaatttttacaaagtaatgggattcaaagaaaggaaaaaaagatttttcttttttgtcaaaatatcgatccaatcagattggtaaaaacccccacacaaattaaagaggaataataaaaattgcaaaaataaaaaaaaacttttgcaaatttttttatttttccttctttcttttatatcatgtgaactaaaacagtcttctgttaggggatgggggcaagggggatacctgatgacattaacaatttaataacattaacattgttgccaaagaggtggtctctttgctgaaaatgggtttcaagaaaaatctatttttataaaatataaagaatttttacaagagaatctggatttgagaaaaaaatattttgactggctaatttaggggaaattgacaactttgtcgcgttcatactgcactggtaactttttagagatcaagatgtgtgttttaaactggattcgtagactgttttttgaaggatgggctataaacagatgatcttcatatcttttcatagcatgtaataataattaaaaaacaattattaattactaggggaaaggagtgttcgttctacccagggtaccacagttccccacagtcaaaacccaaaagcaaggagatgagttgaaagacagtttttctttaagtcatcagtatgggatgtcagcagaacaaaaattaaaaagattaattttccttttgatctaaaacttccttagtttgagcagtaggtgctacaaaattatttacatatcttagtatcatagttaaatgtaatgtgtttaggagaggaaaacaaaagatacatttgctttaaattcattaagaaattttcaaattcactttgtagcccatgctgatagaattgggctgtgttggtacatttgaaacactgtttatgttgcttgaaacacttatttatttaatcgccgatgtgatgatgcctatggccgagatcaaatatagctagattggctagactacttatttgtttacttaaactatgggaagaagcatattattgtgtcattctgttgtgtgtgtatgtgtatatacaatataaatatatatatataaagttattttttctttgggttaatttattataagttgtaacacttggctagttttgtttgtatatgtcttaaaatgttttcttatgatatttaagtgacagttaaagaggtatcaaggtaacttgtgtagaactattctttgatatattgtcatgtttgttgtgaatattttttcttactgcacagtagaaaaataaaaacaactgagtctttattttaatgtaactcagattggggaaaacaaaacagagctaagggaacaaaatgactgagggagcactctcccacgtccagtgcactgatcattttagtatgtttgtgctttgtacggttatatatttaaaacgaaaacaaaacaaaaaaatacaagggttcatgctcttccctgggtaatagaaacagttactcgctatgcataatctagttgatagttaaatttgctattgcttttcttgtcttgttatataaaatcttttcaatacaagtttagtcttaatggtaataaaacgttatggttatttataacttgtgcttattttgtgcattttttcccatgctgaacccactaagtgcatgtagacaggactgttgttttcacactgaaaaggcaaactttgtagtagtcgttgtagtggtagacagataacgaataccaaggctgcatcatagactcctcctttaaattttttttctgtttttttttcctcttttcggttttggatataacaccagatttcagttcagagaacactcgttcaacattcagggaaagctttttacgtcacctgctatgaatgaacgtagtttgctggcaaagttttgatgcatttgctaagcattagtgggaaaggcatgccaaaatcttctctataatgtgttcaatcttgggggaaaaaaaaaggaaaaaaaatcttaggaccaggcagttgtatactttagttattaatgaatgacttcatgttaatcttgctagtttagatgatttccaagggaaagtattgtaaatgtttttttttcataatcttgttgtgtttgaattatttgtactttatctgtccagacaataaatgaaagtgtgtagaatggaaaaa

SEQ ID NO: 59 - DNA, 1380 bp, Homo sapiens
  nbla20083
atctacaaagccagatgctctgtcttcatatttgcagacatctagaccccttgctaaaaacccactgaagttttttttttatgttctttgacccacaccatcaacactaccctcaaatctaattgccctacagcatattctatcatgtggactaggttcctggaaagccggaactcatgattctttttcaaactgccagaatagaagggagagagaaaacatttctaccctttgatcaccagtgtgaacagaatccggaatgcagtttcagcgtgacctgcagtcattcatgttcattggatttgacagatggaaacccaaggttatcgaagattggaaggttatcattgtgaagaagtagctcaaaggactccggtttctgtctacaagtgtgatgtctccatgaagaagacttagtatggatttgggtgggtaagaaagcatttaaacgcccaggaaaggacatgattaaagttgaccttttaatactgtagtaccttgctgttaagtaaccccactattgtatctgcatttatcttttgttcatctactttcacttacatacagtattatataagtagagaaaaatgggaaaatgcaagcaaattcaactttattttatacattgtatatatgtacaccctacactattcatttgggttttattaaagagatagtcacaaagggcttacgaaaatcatttttgaattgataattagaatattgaataagcaatcctatgatccactaatttgttttatcagttaataatattaatcaaagacatttactgtatattctagtcattttgatttgagttaaccccaaatataaaattacctgtagtgatgtctctctcccagcccttatatgtggatattttttaagtggacttgtatgctgataattctagaccaaagtaaatatggcagaatatttatacatgaaaaaataattttgcaaatattttctataattgtattcatttaaaatgttgatagcttgtgttagtttcagggaggggtgtatattttgataaaaaaatacttgactttgtaattctgtatattctatacaatttatagcagagccgttttaagacagccttgtcacatttttttgttaattgtgaaaattttattgagtgatgtttaagtatgcattgagtacatgaccaactagaattaaagtaagtgtaaacagtgaacatactgtatgctgtacaagatataatgtaacttgctgttttagcatctgtattttggttagaagatattattaaatgcagatgttaaggattggaaaagtctaattttatttttagaaataatggatataaatttgtttttgcttgattaaaatagcttattcctacaaaaa

SEQ ID NO: 60 - DNA, 1833 bp, Homo sapiens
  nbla20182
ttgtaaatgctgggcctcctgtgatttgagtgaggccaacaggacatccctccccagctcccagggcccatgctgtggtgggactggtgggtgacccacctcctctgggcctctcagtgctctgggactataaaagctgaatccccactggagctggcctgagaggtgggaaatcagctccccaccctgccccagtgttgggcatctgggacctccaaaggcagagtccatacccaaagcaccaggaaaggccactacggtggtgtttgggcgtggaggatgtgctgtctgggcttaacggtcctgtcctcgggaaatgactatagagcagagattcccagcctaggtcaaattccacagggatcggagctactggaatcctggaggccgacctgggcctgccccatttcccctaggtggtcccaccgcccttggccactccaggcccttggccgagagagcaggcagcaaccagggctctgtcctccctgcttcctccaaagccaaaatgagagacaggcaggtacccaggcagtgcccttggaggtgtggattcccccgcgcgctccacccagcttggcctttgcactcccgaacccccatggggctcctctgcccgccgactcccattcaggcgggagcaccctgagaagatcctcatcaggtgcaggggaggggtgcccagtgccctcacccatccgcatgcagggaggtttcccagatccttggctctgagcccactccgaaggcaacccagctgggcggagacggaaggctctggactctggctgggtgagcagcaccagggaggcgggagaggccgggtgggcttctctttccctttctgtcagtgcctctcccccaagagtctttcgtggccttccgccccaccttgcaacttgttggaaagggaaaccggggttctgagaggggcaggaattctggagcacggtggcactgaggctccccggcgccctcctccacccgcctgagggaggccagcgggctactcctgcgctggtgctgctgctgttcctccccgcctgtgcactcatatgcttcatacccttcggccaccctgcccttctggtagccagagtgggcatgcctatccagggtcccgctgggaagtggggtcccagccaccggaaattcgttcgctgggcctcctggactcgccgatccccaggtccccaaggcggatcacccaatgaatgactgccctggagggaaacggagaggtggacaccccttcataggtgggccggagaggggacagccctgtcctcacagagctaagctctgcgtgtcatgcacggaaggacacacaggatcgggcgccgagaacagctaagtggtcgaagagccagcctcaccgcctggggagcaaacggccctcgccacgttctggagctgtggggctgagtttttgtttattttttattacaaaagtaatagtgctttttattatctggacattgcagtgaagttcaaatggaaatacgtctgcacttccaacatcaaaagccaactgcctttgagtgtggatttactgggaattgtaacttaagccgtattgttattttaaaaaaagttattatcagtgaaaatgcatttatgtattcagtgaaaatgtgtctgtgtttgctttataataaggcaacaaaaataagttagtacaaataaaaggaggccaatagagggaactagattggtcacggtttaagaactgtgggataggggtgggtacacgggaattcacttgaagcctccctcgattttgttttatatttgaaaacttccataataaaatgtttcaaaaagtgacaaaaa

SEQ ID NO: 61 - DNA, 1664 bp, Homo sapiens
  nbla20248
tttcaagcaccatatcagcatgatcagcaatataagtagtatctcagtgctttgttgtttagtcagagttttgtactctatcacccattgtaatgttcctatttgcaaaaggtaatacataccctttaaaacatctttgctttttctcccattatcgagatgctagcagcttcataaagcagaataactaagggcaaacagattatataaagggttggagctcaatgaagacaacaagaacagcaaaggttattgtaaaactggctgcttgcaggccaacaagcacatccatatggaggcaatcagtttatgctacctctgtctgtttgatgggattcataatattgactttatccattagatttggactaccagggaataaaataagcagatggagagtaaggatttgctaggaaataattcagccagtcactttgaaagctgttcaagaaacagctttcaaagtgtctctcaaactatgtttgcccattatcccaataatttatttcccaataatttcatgggaaaagaaggaagttctgtggtcagataaatctggaaaacactggtttaagcaaagttcagtaggtctgcttccctgcaggtcacctcagagtctttactctgctaacctaggaactcatccaacaagtttaatttaacagctacactgtgtacgtcactttaacagtcactgagctgtgactcttgggggaaagattgtgcgtgtgtgtgtgtgtgtgtacacatgtgtgcacatgtgcagaatctaccaaatcttaagagaaaggaacatgctgggaaactgtcctgtgaaagagaatagaaacctgaagatttgaggcagtgatagcatttatgaaagcagcagataaggactaatcaccaaaaggggtagctcttttgttggttggggaaaacaggaatttttcccccacccaatgtgctgcattttctaattttctatgaacacttcctaagaaaaagctgaatgaagaacatttgcgatgcaatcagctcattaagaaacacgcacttttgtggagatacgtgctgtcccaggagatgctctgcgaggagccgagtgtttggactggagctgctgaatggtttctcacagttctagaatgtttggggctgcaccctctaagatgttgaacccatcagtaattgctccaaaccactttatgggatataatgctgtgagttgacacctgaggggattgtggtcctgttcatgagtaattacttttctgttgcctatagaagggccagcaatagcagatgagtagctgaacagtggttttgagtaataaaacgttcttttttaaaaaaaagtaatgctttctgttaaactctgactatactctctcctggtatcacaacccagctttctttttgccttctttattgcagttacatatggggctgatgactttagggatttccatgcaataattcccaaatctttctctctgttggaattgtgactatcttctcacacaagcggctacttggtcttgatgccttcccccgcaaaacagcaaccaaactgttctgggccaatatcaccaccttgtggtcatgatgaagaattgccccctttgccctcaacacctcttttcttcttgaaaattaaaaacaacccctttcacccccaaaaa

SEQ ID NO: 62 - DNA, 1531 bp, Homo sapiens
  nbla20250
ctttaaatttgactcaaatggaaattgtgcactttcctgtttatacccttccccacgttattgtaaaagagtttaacagcagcctgatatgtaagtttcagcaaaacttatacctgtatatgtttttatttgactcaaaaattagatattttaccatatagtcataagaatttgctcactttgatgccagaagtacttaagaagttacacggcactaattttatgagttgtatgcctaatttcaatttctaacctatttgacagtttcttttaggtcagcctttgttggtcttccatgtaaatacaagttggtacaaatcaatagaaaccattttacctacataggcaaagtaaatgtgtgacttagagactgccagatttatggtgcatctacctttttatccatttgagcttgcttttttatgtttgtgtattggttgctcctgacactatacatttcaaaattttttataacttgaaaaacacttctgtgctaccactcagttctgatcaaatccttacattttgcaacactcatttctgaattttcagtaaagaaatacacattacaaattaaaggttaaaggccccttttcatgcccttccccagtctcctcttcctcccccggaagtgtccattctgctgaattcaggttcatcattgccagacaaatgtagtaagctagtgtttcacatttccaaaatcagccttctggcagacttggaagtactcttgagaaaagaagactcgtgaccaaattctcccacagatttgtaataatgtacatattgaaaggactgaaggctctcagactgggaaagaaacttacccattttaaaattcagcattgctcaacttacctgactgccggaccccttcacccatgattctatgcactgtattgttggaacatacattgtgaaaacactgccctgcctaggcataccccctttccagaattaactttccatttaattctatagtttttcactgatgtaactttctagactggacaacaaagatgactaatagtaatcactccaagttgatgttgactgttgggttgtggtgaaatcattttgcattaaaggaaggtaaaatactaataaattgcatattccttgaccagagcacagattacttatgcttcttaattttttaaaatcttaaatcctctgtccaactggagtatctggctatgggccatgggtactcatataccctttgtcttaaactgatctgttacattttatgttcttgtggctagaagtagcctgagtttgctgttaatgtttaacacattttcttgagtaacagttctgttaatattgtacaagatggtacttgaattctttgtttgccttttttcttcctgtattagaaaatcttggtgctttttataagttttgtataaaagaattttttttaagatttgttcataaaatggtctgatccaggaaaaataaaatgggaacatggacaccatttctgaccttcaaataaaacttattatgtattggttttcaaaaa

SEQ ID NO: 63 - DNA, 1871 bp, Homo sapiens
  nbla20330
gaaatcagaggtatgttgagcagagtaacctgatgatggagaagaggaacaactcacttcagacagccacagaaaacacacaggccaaggtgacagaggagttagcagcggccactgcacaggtctctcatctgcagctgaaaatgactgctcaccaaaaaaaggaaacagagctgcagatgcagctgacagaaagcctgaaggagacagatcttctcaggggccagctcaccaaagtgcaggcaaagctctcagagctccaagaaacctctgagcaagcacagtccaaattcaaaagtgaaaagcagaaccggaaacaactggaactcaaggtgacatccctggaggaggaactgactgaccttcgagttgagaaggagtccttggaaaagaacctctcagaaaggaaaaagaagtcagctcaagagcgttctcaggccgaggaggagatagatgaaattcgcaagtcataccaggaggaattggacaaacttcgacagctcttgaaaaagactcgagtgtccacagaccaagcagctgcagagcagctgtctttagtacaggctgagctacagacccagtgggaagcaaaatgtgaacatttgttggcctccgccaaggatgagcacctgcagcagtaccaggaggtgtgcgcacagagagatgcctaccagcagaagctggtacaacttcaggaaaagtgtttagccctccaggcccaaatcacagctctcaccaagcaaaatgaacagcacatcaaggaactagagaagaacaagtcccagatgtctggggttgaagctgctgcatctgacccctcagagaaggtcaagaagatcatgaaccaggtgttccagtccttacggagagagtttgagctggaggaatcttacaatggcaggaccattctgggaaccatcatgaatacgatcaagatggtgactcttcagctgttaaaccaacaggagcaagagaaggaagagagcagcagtgaagaagaagaagaaaaagcagaagagcggccacgaagaccttcccaggagcagtcagcctcagccagttctgggcagcctcaagcacccctgaatagggagaggccagagtcccccatggtgccctcagagcaggtggtcgaggaagctgtcccgttgcctcctcaggccctcaccacttcccaggatggacacagaaggaaaggggactcagaagctgaggcactctcagagataaaagatggttcccttccacccgaactgtcttgcatcccatcccacagagttctagggcccccgacttcaattccacctgagcccctaggccctgtatccatggactctgagtgtgaggagtcacttgctgccagcccaatggcagctaagcccgacaacccatcaggaaaggtctgtgtcagggaagtagcaccagatggcccactacaagaaagctccacaagactgtccctgacttcagaccccgccagacctggtgaagaggatcataaccctgtcttcaagaacactgggatttcagcagcaagttggaagaaggactggtaggttcccctccaagccagtcacctgtaagagtcctgtcctctgccagactttttaatctcttcattaactctcagactgacctgggagccctcctctacctgaatccagtgctcaactgtgccccggcaacaagacctgggctgaggtctccctggtagaactaagggagattacaccatctaaatcccagtgcagtcaacagcctggcctatagtcctgggacatgtatcttcttctttgccttaaatctgatacaagaggtcaatgactttgaaaataaaactaaaataaatgtctataatgaaacttgaaaaa

SEQ ID NO: 64 - DNA, 1474 bp, Homo sapiens
  nbla23983
taaacattccttgtgtatctttaagcatgcttctcctgaaatttaactacattagtagttgacatttgtatacatatatcctaatacaagagtaggataaggtggaaatgtaatggcctgagggatggtgaagcattcttttagtatttttcatcatgttgggctcctagattgtactggggttgcccataaatcaaaccccatactcttagaattcattatattatggtgatatccgaacctagtgaatggtatgcttgggtgttttccattgagagtggatggacctctttataaagttggttgctgcaaaatccagttcttccaaaagccactttatttagggtttattcacaagtcatatccattttggtacagtgtttgtttcctaatatttattaaccaccttataccaaatgtcttgcaaagaaatgttattaaaaccttgaatttttacaaatgtaaaaaacaaaaagtgtattaatgtatttgttcaggaaaagctacataccgaagggcttttgtatatgaattctgtggtggggagacccatttgtaatctatatggcagttccatctgggttttaagtttagatttcaccgtgtcttagtgcttcattctattggtttattggaacatgtaataaataggagtagtgatgtattaaaacacaagtattcattaatgttttatatcttcactaaaattctatagttatgaaactattttatcaatcaaggtgttatatttcagtcagaagtgaaaatttatgaagagtatttggaagtgtgtacagaaataaactagacttacaggtaggctagatcagaacgttaacatatgaacctgcagaaatctggtaagacttaaattcagtgtgaggaataactctagttctctcctatgagcatttcctaaaagccatctgatttggcattcttactggagctgcagacagaaatctacaaagacaaaagtaaacaaaattaagttattattccactgttaggaatggaaataaacttgtgaagtctgtttattttgaagtattggtgaactaggcttgctaattgataactgcagcagtttgtgtttactccagttcatcagcttaggtcatttgaaagatataagagcttaaggcaagaaagaaataacatggaattctatttgaaggacaacagaacattcttggaaaagcagctccagttggtttttcaactgtcaaacttgaatgtgtaagtccccacagagcatggacagtcggtgcagagttccaaggaaacaattattgcctgatgaccacttccattttgtatacactctttggttcgtataggccatattccaactggctttttagtaatagaaatccagtatataatgtatcaaatacaattgaggttctaacctagtgtgttaatttatctgaatttggatttttaaaaagtaataaaaagttaaatgtaaaaa

SEQ ID NO: 65 - DNA, 2167 bp, Homo sapiens
  nbla24111
cttataaaaattttgaagcccatccccatggatttattataatacagctctgatatatcttaaagttaacccgttttccgtagatgttaagggctttactggttgaggtaacctatttcaaatggtctgttgggttttgtggtaccttgtcaagaattcaataagaattctcaggctgtctgtattttcttttaggactttggagatctctcaagttgtactgttttctagtattcctgagtatattcctttggtaacgtgaaagtaaatagtttatatttgatgattttttttttttttttttgagacggagtcttgctctgtcacccaggctggagtacagtggtgagatcacggctcactgcaagctctgcctcccgggttcacgccattctcctgcctaagcctcctgagtagctgggactacaggcgcccgccaccacacccggcgaattttttgtatttttagtagagatggggtttcaccgtgttagtccaggtggtctcaatctcctgaaccttgtgatccacctaccttggcctcccaaagtgctgggattacaggcgtgagccacagtgcccggcctgtatttggtgatattttaaaaaattctactttgaccttaagtgcttcaagaattgtgttcagttagtagtccttttgtaagactaactttcatatgctatctttgctccatgagctatcatagtactgttttctttcattacccgtaagagtggctctatcacagcatttactgttaagggctacagttagacctcttgttaactctacttttatttgtgatggctgtgtttcacactaccttgatttataaatgtagtaatgtgttaaataactatatgttgtggtcccttaatacctcttttgattggtgaggtaacagtgatgtggatgatgaaataaaaacgtttccccaagtcactaaacacagttttcaattcattttttttttacatatttaatttacatctaactactgttaggtatgcagcccgttcctttttgccttcagtagaatatagttatataagtagtctcatttagattcttgggacagaacggcctgtgtattgatctttctttaatggcttggaacagcttctatatattctgacaggtcttggaagcatgttaatatccgtgtgtttaattgtcatcttcctgcctgggaaggcagtagaagaaagaatctacatttgtatagtctgtagtacaggctctgtgctgattgcaaggcactcttgagagaaattcattcttattttgcagaagaagaactgaaacttcattaagtcattaagcaacttgctcaggtggtggaactgagctttaaatatggactttttccagtctcaattcagcattatactaggctgcctccatgtgtttttcaaagccccattcaagttttacttctatggtaaactaattttacatacacaaatcttttcattttctgaacttcctttatggctttactgtcaccccactagtatttgatgtcttagctattaactaattcctgattatttcacttgtcacatcaggaaccctatcctcttagttctcccattgagatttcactgctggactaagattattcttgattcgtagtcattggtttctgtttccattcattttcagcactgattatgttaatcgtattgcttgagttttttctttgttcaatgttgtttattacattcattttgtttcatatacacacatttttttttttttaactggcattttgaggatattggtttaatggaaggaaaaaggaatggtgcaaagcacatggtatttgaattccaaagaccttgaccctcagcattagcaagtcacttgttttctgagcctcagttttcttactctcaaatgaggtaatatccgaaagtactttgacaacacactaaagcctgatgcagatttcctttttgaagtaattgtgctgtttctattcatattggatatggtattctatggtattggctatagatacatacattttaaaatgttatttaacagcatgtaaatgttcatttcatgccatgtgatcatgttcccctttatgattttttaaggctgtcttacaagcctaacagtgtactaagtcattaaaagatatatttaaagtaaaaa

SEQ ID NO: 66 - DNA, 1388 bp, Homo sapiens
  nbla24142
gtgctttttaaccaaataaaagaagaaccagctcttgggatatgtgactctgcctctgtataaagtgactggaattttgttaaaaccgtgtttccacttctgaaccctgttaccattccccctcacaaatccccacccaacacctggattttaaagatcctccagtgtcaagggaagccacagagtctattaaagaggcagttctgaaccaattaatttttgtccttataatttagagcattaaatagctaatatatttaatggcactaattgttgttcacggctttcatcatacttttaaacagaatccaaagtattcaaaggaaagtaagcgaagttatccaaagccaactttgtttcaggtgtgtcccctgccccaaatagattttagggcagaaatagaaaactgagtttacacagaactatttttggaaaagctgcactggagtagatggattcttcttcagcatacttttttgtttgtttgtttgagatggagtcttgctttgtcacccaggctggagtgcagtggtgtgatctccactcactgcaacctccacctcccagcttcaagtgattctcctgcctcaaccttccaagtagcttggattacaggcgtgcgccaccacagctggctaatatttgtattgttagtagagacagggtttcaccatgttgtccaggcttgtcgaacttctgacctcacgtgatccacctgcctcagcctcccaaagtgctagattataggcgtgaaccactgcgcccggccagcatgcatttttaaagtggcttagatttagttttaaatattttggggtgaaaggcaggaacagttctgtttttgacatacaggttttctttgggattgttttcattttcaagtatagattcatgtcagaatggccaacttaacgtgggtttctgtattccctggtgttgctcttaacctgaactcataatcagttgccatactgaggcaagagcactcagggtgaacatagtcaagttactttaaaagtgataaaagtgtttttccatggtgaaaccttcagtatttggctgaatgtaaagtatgttgaagtggtatattgatggtaagttgttaatcactaaccttgtttgcacttttgtacaccactgcttgcactaggatcttggtgtgaattttcaattgttttacagtgtatacagattattaaggataatttatataaagatgtttctgtttaactttgtgtgttttacaacaaagagctataatagatggttaaacgtttttgaattgtgtttatatgttagtttgattatgttctattatcttttcacctgccatgaatttgagtgttaggaagggaaaaataaaatactaatctggtcttgaagaaaaa

SEQ ID NO: 67 - DNA, 2357 bp, Homo sapiens
  nbla24157
aaaaaaaaaaatacttgtctgaagatgtatgcaagctaaaattagtttatacttcctgtattctgggaacattcagtttcatggtatctcttaatttcaagtgtaattttacttacaataaaatactcattttctttgataccattcttattttgtattttataattattttcagttactaatggaaaatatgacctatgtgccataatttaatattatatttctactttctaatgttaagaacttaaacatatctaaatctaaatctatctatctatctatctatctatctatctatctatctattagatatctgtctatgtaatctagctatctgggcatatattatttgccttgacattgtttcagaaaaggacaaaattaatgtttagaagttttgacctggcttctatatggaggcaccttcagataatttaattaaattagataacatgtactaaatctatactgagcctagtttaacaactaaattgttctaaaactacattctcatgtctccatttgctttacttgttcttcagatttatagcttgactacatttactagttaatcctttctaattatatgtttgtgtttatcatgtagcgcatggtagaaagaaagcaagtaaaagaaaaagcaaaaaataacatcagtaatactttaaatgcatacagtagttaataaaaagattttattgttaacttcacgtcataggttagcagaatagactctggaggtataggtttggatttgtattttatcacttactaaattgatgaccttatttacgttatatattacttattgtaaaagaaatgtaatctggaaaactaaatagcataattaaattcgggatggcagcaggatagaatactgttaaataactgcactgcaacaatttagtgaatctcacaagatctttataatcccttttccaagaaaaactgccatttaataaatgttatacatgattttatttaataaataaaaactgaaggaaagataacctaaatctatttttttaaacaccagcaatctgtaacatccctagaaaattgtctagaacacagcattcctaccttataacgaaactgtatctcttgcaagcaacaagaaatttctgtttataattttctaattcctagggctcagaacattgcttattatagagatatgcaaaaaagtatttgttgtttaatgaacagtcacttaaatactgctatcctctgcagtctgcatgaaatcacataataagaccatgattgttcttatgtccaagtcaatacttcattggtctaactgcatcagcttgtctgcaggggatttctggaggtttgggggcttgtttcatgtattttcaataaccaatttatcacttgttgttctactctggaaccctgttttcttggctatgttgtgtttgctatatgtgtgacacaaagatgtcactgctttactaagcatggcagttttaatgatgactgtcactctgaacttagggcaatggtgtaagtcttcctgttttattttgctttgtttgtttttcttttgtttgtttgtttgtttgtttgtttggcttcctctgtagcctaggctggagtgcagtggcacgatctcggctggcttgctgcgacctctgcctcccgggttcaagcaattctgcctcagcctcccaagtagctgggattacaggcacctatcaccacacccagctaatttattttttatttttattttttatttttattttttttttagtgggggcagggtttcactgtgttggccaggctggtttcgaactcctgacctcaggtgatccacccgcctcggcctctcagagtgctgagattaaaggcgtgagccactgcacctggcctttttgttgtttttatgtcattttcttgtgcacttaattaatacatagtttagttaaactgaattaaattatctaaaactggttaaggtaattaccttttccataacttctaacagcacaaccacacccaatctgtaacttttagcattggttgaatgaaaaatttagaataatgcatggccaggcatggtggctcatgcctgtaatcccagcactttgggaggcagaggcgggtggatcacttgaggtcagttgttaagagatcagcttggccaacacagtgaaaacccatctccattaaaatacaaaacaaaacaaaacaaaaattagccaggcatgctggcatacttgtggtcccagctacttgggaggctgaggcaggaggatcgcttgaacccgggaagcaaaggttgcagtgagccaagatctgccactgcacaccagcctgggtgacagagcaagactacatctcaaaaa

SEQ ID NO: 68 - DNA, 1522 bp, Homo sapiens
  nbla24230
tttgggcttttgttgggcactgtgtgtctcccatgttccccatttgtctgccacccaataagcatggtgtcgagggctgaagtagaaatcagaggctagaatctgaaagcttcattagggttctgctttttgcagattagggactttggcccttagtgagctgaggatcttggtttcctcccagtgtgcggtttcagggatgtcggccacatgatgtgcctgttgtggaggagggctgggtcgccagtgtgacaggagacagcagatcccttttgtgaaaggagaactggtactttgcgtgatgttaaacttcacaaaccgctgctcagaaatctgctattttccttctcttttaggactttatggacagcagcctgctaaccaagtcatcattcgagagcgctatcgagacaacgacagcgacctggcactgggcatgctggcaggagcagccacgggcatggccttagggtctctattttgggtcttctaggggcctcaaggtcttgatgtgcatagcttctgataaccctgtgtgcaataatatgatttgcagggcatttctgtttgtgacaaaagtttttaataatagttttaatcattcctttgaaagtagtgatgtcataattgtactaatccacataagtaccacagagaagggtttgaactgtgctattttgttcaaatgttgactctccgggggcactggctcattccaagactgttcttgtgcaactctcagaataccttatttgagcatacctgttttgaaaggcattttctttttagagttaggtgtagtgcttaagggttaatttattttcatgttatgccagtaatatagtgttgtatgcctattgagtgattgtggcaagaaaagctacagcttctttgcgtttaactttttcaaaccacagaccagaactggttgcatgttactttaggagttgtgggttggtaagctcccaggtacttcccgaggctatggtgtgagagcccccgtcctgccctctggggctccacaggcccctggcaaggccgatggctcaggatgatggggcacagcccgcctttgaacaatcatgcttcagaaatctgcctgaccctagctgctgctgctgctcactttattcttgtatggctttggtaggcatacttggagaacatatcccacattaggaattgatttaagcctgagagtttgagggctttaatcctttaaaacttggagaagctggctgggcgcggtggctcacgcctgtaatcccagcactttgagagaccgaggcgggcggatcacgaggtcaggagatcgagaccatcctggctaacacggtgaaaccccatctctactaaaaatacaaaaaattagctgggcgtggtggcaggcgcctgtggtcccagctactcgggaggctgaggcaggagaatagtgtgaacccgggaggcggagcttgcagtgagccaagatagtgccactgcacttcagcctgggtgacagagtgagactctgtctcaaaaa

SEQ ID NO: 69 - DNA, 2098 bp, Homo sapiens
  nbla20541
aaaaaagtaagcaaaccaatacctggtgaatctatggacagtcatacacatacatcaggggaaaatgtgtgtgtacaacccaaatttacagtatgattgtcattctttgactttgttttgtatagcctgactctgttgaacatgaaattattagtactctaggttttggacagcttgagttcatttgaattccttccttaggaataagtttttatatacactgctaaatgtgtgatgagaatcataaaacactaaccagctgaggtagctgtgattcactttccccccaccctaacttgagataaaatgaaggactaggcaagtatttcatgttgtgtgagtggacttcggttccttcagtattgtctaggttattgagtctttctttgcctaatagtggattcccactcttaagataacttttattagtgataaatcagtttagggtatattctgtatgacaggcataaaatgttaagggtgaatgctggccttttccaagaaaaggccaccttaacttgtatgaggaaaaaatcctaactattctctttttttgtatctttttttccgtaactgttttgattgtatattttaaagaaaccacttaatttgtgatgcacgtaatatttgtgtgaacctgagaatatgtcacaataggaaaaagcagaaattatacttaggggacatgttaggggggtaaaaatatttaagcctcgaatgttttactgtcatctccactaactatttttacagaaaaagctaaaaactctgttgtaattattgtaagtttacttatttatacttttaaattaggcttttcatacttaaatttttttgacatttgcttttaatatttgtttcttaatgtggaaattgtgtattttaataatcaaattattaggataatagatatatttttaaacattcacctcattaacaaatagatctttgaatttttattaggttttttggctccagacaactgtttagctttaatgatatttctaaattcccagtgacttattaataaaaacaggaaaaatatttaggtaatgtcataaaatttattttacctttctcattttctgagaaaataaatgaaaaaaaccctagatattgctttattaccaacagtgtgtaggtttttgtacatatggaaatttgacacaaaaaaatagggaatttgtatagagaagtttccctcttataaaaggactcccatttgattgttcgaaactataaaatgcacttttactttaccatatctgaaatgacaaaatatcgccctttggaaaacctgactctttgcacgtgtaattcccagagtctacctcagttaaccaggcttagttttaggcaggaatgaattgaattaaattcagttcatcatctatgcagatttgtttcttttaagcacatccttccctcctgctgttgccctcctcccattaacttttctttttaatcttgaaattgtttaaaatattccatctttctttctctagcaaagtgtttgtattccaaataaggcctctgtgaaatgtctgaattacttttcccgtctttgttatggtcagcttcattatttggatgtattgcattcaaagcagcagttccaaacataacacacatctattttcttagagttttgtaaatacagactaacctgatgacattaaaaattgtggatcctacatgttcctatgttcattctctaaaaacctgagtaactttatgaaaacacacaaacctggaaaaacatcacatttttgtcacatttttactgacaaatgtatattcatatgatggtacggcagcagggagtggcccccagttaacatggctgtgagtggacacagtgtctcgcaggatcactgcatgttatgatggcttgtaagtgcgttgttaagacttttgtttcagtgtttgtctcccagtatttgaacctaatttaaagaaaaagacgtttccaagttgtatttattaaatgtgtttttccttaccttttgtgctgctactttgctaatctcattagcttagctgtgtttgtgcataggttatatttggtaataaatttatagagtgttggttgtaaaaa

SEQ ID NO: 70 - DNA, 1332 bp, Homo sapiens
  nbla20555
tgggaacgacaggaattgccctctgcagtaaatgacgtttattgctgacaggcaaggggaaacatctcgcccaccatactggcaaccacaggcctactggctattaagtatgtgcgttccgtggtcagctggtcctggtttctgctttctggggacttcatagctgttagcccatgggcagttgatgtccccagtctgagttttgtttacttcctgtgtaaagagtagtccctctatattaataccatgatgatgtttgtactcattacccatcccctagcacacactctctccctttcagtcacttagcaagcactcaataagttcagcaaatatttgctgggtacctattgtgtgctgcatacttttgtagggacaaggtatgcagtgattaataaaatagagaatttccagtattgtgttgtgatgaaaacaaaactgatgtggtggggccagcatactgagaggccgaggtgggagggtcgcttgaggcaaggagaccagcctgggcaacaaagtgagacctcatctctacaaaaaaaaaaaaaaattaaaaattggccatgagtggtggcatgctagttgggagcctgacccagggggttcactggagcccagttcaaggctgcagggagctatgatggtgccactgcactccagcctgggtgacagagtgagaccccatctccaaacaaaaaacaacctaggctgggccgggcgcgggggctcacacctgtaatcccagcgctttgggaggctgaggtgggtggaacacttcagatcaggagtacgagaccatcctggccaacgtgctgaaacactctctctactaaaaatacaacaacagccgggcgcagtggctcatgcctgtaatcccagcactttgggaagccgaggcgggcggatcacgaggtcaggagatcgagaccatcctgactaacccggtgaaaccccgtctctactaaaaatacaaaaaaattagccgggtgtggtggcgggcgcctgtggccccagctgcttgggaggctgaggcaggagaatggcgtgagccattcgggaggtggagcttgctgtgagccgggatcgcgccactgcactccaaaatccagcctgggcgacagagcaagactctgtatcaaaaaaacaaacaaacaaaacaacaacaacaacaacaaaattagttagacgtggtggtgcatgcttgtagtcctagctgcttgggaggctgaggcaggagaatcacttgaacctggaggtggaggttgcagtgagatggaggtgcagtggcactgcacactccagcctgggtgacagagcaagactccaaaaaaa

SEQ ID NO: 71 - DNA, 2014 bp, Homo sapiens
  nbla20645
gtgcagacacacatgcaagatacctgtgaggctgagcctcaagggggtctccaggtacctagatgacagttgcgtgacttggcacagcgctgaatatggaggcaaagccctgggttgactgagaacaccaaaggcctttgcagctgttgcctcacttactctcatccccttgttttctggtgctggccttccttggagcttcttaactggaattttatttctgatgaccactgggccagctgcaccattgatcatatacaggctcccttgctatatgcatcgtgtcacctccaagaaaggggccgggcagcagggcactggggtatgtttttagagcgtagcctttggtgtggggtggcactaagggaacacaaaagtgttgttgaggatgtatcccaccatggatcatgtcatcccatagggttcaggttcaagacagctcaagagcgggtcctccctccctcccactctcaaggggatttaagatacaggtgttcgtcccggtgccttgcattttgcaaatagaaagctcaggctggactctgcacgggagcaggaggagtgcacagagaagtttgagagcctgggtctcttctagcatcatggtttcatgccatgttcttcaaaacccacggagaaggttctgcatgtttgcccctagtgtcactttttaaacttaatttaactattgtagaaactgttaggaaaacccgccttgctgtcaacctttcactcatgtgggtggcagaaaggagcttttgagtgtggtcttggccaaatgggaaccccttgggggccaccggtgctttgcttcaggctgctgggtagttttgtgctgatctcaggctgctgctgctgcatctgccttgtccgcagtggtcaagaactgggaggaaactgctctcctttgctttctttatgcatgtaacaggattttctcaacactgtgtcaccaaagcaaaacacagaaataatttggtggctaaggctgtaactagccttcataaccttatctgtaaaactttgattcactcagtctcatttttggctttttattgggtcaaagatacacattttaactcataaaggaagagtatactaataacccattactgctatccgtttgacgtattgagatccacaagagatttaatttcgagagggagaggaagggttctgctgctaagtcgaaaaatcaaagaagttagaaaaacactgatctaccgagtagagcactgtgctcaggattaaagacctggattctcacctagttttgccagggaccagctgtgtgatcttaggcaaatcacatcacttctctgggtctgtaaaatggggaggttgaactggtaagatcttttttaccttgaaattctataaatgtttctaactccatttccttcttacttgacttttccagcagcactttatcctttaaagatctgtggtcatcactgacctcagagcccttgcctctagattatcttaccctgaaatacttaggttttaactctgtggatctggaacacttcaagagccagattgtttgaaactttaatggggtatacccctgcttcagcttaacattattttcaaaccaacaaacatgtcccgcaaacacatatatttaaatgacatgacatctgtgtgggctggagtgtttttcccgcctcagcggcagccatactactacaccagtccagatctgtttgcagagctgccgtgttgtgcagtccagaggtgctgctgctgttgtattctgcatggaggtagtcaacaagacagccctgcttaattatgaaatgtctgtagcaccctgtgtacgaaggtgtatagaagtgtatagaaagcacccaaaagagcagcagcttggctgggcgtggtggctcacacctgtaatctcagcactttgggaggccaaggtgggcggatcacttgaggtggacggatcacctgaggtcaggagttcgagaccagcctggccaacatggtgaaaccccgtctctactaaaaa

SEQ ID NO: 72 - DNA, 1753 bp, homo sapiens
  nbla20713
ttcagaagccttggaggagaggcactgctgagctggaggccgagagcctctggccgagaggcccaggccgaaacagaggctccttcgccctatttttcctagatgtggatctaggattgctaatgaaaacagagaaaccagacttagcgccgactccagctcccgcccctacatctggagtaagagaaaaggccccccgctcctccataaacgactcgaaaacgggcggttgtttataaacttgtggatccggttgttgagcgctgcagcgccgaggcctccccgccggctagggtagcgctaaccttggtagcttctctgcaggggctgggactcccccatcgtatcctttcctctctggttcactgtctcctccggcgcaggaagctccgggttggtgtggaaccaggtatcctctctgaatttctctttccacttttctcgccctcgcctttcctctgtccagaacgaaatcttgaaaagcacagtgagcagcaacgacaagaaaaccaaaggccggacgggctggccgcagcacgtctgggccctggagctcaagcagtgaggaggaggagaaggaggaggaggagagcgcgagtgagcaggggccaaggcgccagatgcagacccaggactccggaaaagccgtccgcgctccgctctgaggactccttgcatttggaatcatccggtttatttatgtgcaatttccttcccctctctttgaccccctttgaggcatctgctccccgtctccccctccaaaaaaaagtggatatttgaagaaaagcattccatattttaatacgaagaggacactcccgtgtggtaagggatcccgtcgtctcatagattctgtgtgcgtgaatgttccctcttggctgtgtagacaccagcgttgccccccgccaacctactcaaccccttccagataaagacagtgggcactagtgcgtttgtgaagtgtatctttaatacttggcctttggatataaatattcctgggtattataaagttttatttcaaagcagaaaacagggccgctaacatttccgttggggtcggtatctagtgctatccattcatctgtggtcgttccctctttgaagatgtttccaacagccacttgttttgtgcacttccgtcctctaaaactaaatggaatttaattaatattgaaggtgtaaacgttgtaagtattcaataaaccactgtgttttttttttacaaaaaccttaatcttttaatggctgatacctcaaaagagttttgaaaacaaagctgttatacttgttttcgtaatatttaaaatattcagaagtaaactaaattatcatgattgcctctaactttattttaaagactcagtggttccaaccagtcaccctgacctgcggcctacgcaggaggaggaggtgctcttaaagagaagtgtccttgttacaaatcctgcaaatggtctggggtttgtcggtgtggtgtctccttccctcttcccccagctggagaacgctgagtagtctctagaaggaagatctgggctggagaacccagtccggcagttcgctcagaaggtgtaaaggtgctcttgctttcctgaagtcaatcagaagccatttcttgaggccgtcagtttttgtttggagagtgtttctggtggaggagttgtgaggagaaccccggcattattgctgcaacgggaactagtctggggtgtttaattcaaactatggggctttcatccaagaaaaa

SEQ ID NO: 73 - DNA, 1769 bp, Homo sapiens
  nbla24250
ggggaggatttttgaaattttatctctaaaaacagttttccaattcagagtttttaaaacccttttaaaaatatagttagttttcagtggtttcttttacttttagtgtttttacacttggaagtcagatatctaaaaatagggaatgttcttttgctatttttagatctctactaaaatgtaatctgtagtgttttcttgtttcagagcatatcttaaaagattcagacaagtggcatttggggacctcttccccatccactggctttcactcaaaggaaaataagacttcttggttctggcagatactgtctctggcagaattggtctcactgttttccttggggagcattttaggtagtatgttgaaagacagatatacatcagttgaagacaggatcagatgctatctggttaataaagcttatgatcagggaaggggcaaagaagacagataccactaccattttgttctttctggttttactaatatgaccataatgagtcattttttatgcatataggctatgtgtttcaggttgcctttccttttcctcctacagatctattgagctttgtgttctaaacaagatagtgtgcttatctgaatgtttcccatctgtctttgatgaaaaagctcccagttaaactaatttggatttatttatttttcctgtctattccagttctctgctatgtgtgggcaagtgcctgttttatcttgaggggtagattttagcatttgaactctctccctttttaaaatcaccttgttacttacagatcatctcagtccagtaacttttctttataaaggttaaaagattgtttgctttcttctcaggtagtctcagtgttctcagccttgagagggaaagggacatacttaatattttcttgtcttgcttgctaagagctgtttttccttcgtcatgtgttgggcagggctagccacccatctgttggaccagctacttcataaaactttcaaaggatgatagtaggtgaaatgaaattgacaagagtgttggatgcaggtagaatgaagggtctgctgtagcgtgtatgtggacttctttcttttgtttatgttcgtaaaagtggagagactctggatatagaaagggtaatagcaaactgatatctccagtacctgtctcctatatgatcaaaaacattaacaatgtgttggttttgtaaaattgctactgttttgttctgaagtgctgtagccattagctggattgtaacagtaatatgacagctgtatagtaaaatactgtctctctttatgataggaaatgaaaaagcatctgttatgaagcctcagtgaactaaaagccattctctgaaaagtcaagacttttgggctttatcagtagataaacatgagccataggttttctagcaatagaatattttaacctatatgaatatatgctttataggtgagactgctatttaatgagagttttaaagtaactaaaccttgttgacagaattcaggatggaaagttttaccctaaataaaacttcaggatattgaatatgatagcaaagttccagggtatgttttatatttatgaacaattttcatttgaatatttggagcttgggggttttggtgagacatgttcatgtatgttatatacaaactttcaggcctggcatggtggctcacacctgtaatcccaacacttcaggaggctgaggcaggaggatcgcttaagcccaagagttcaagacccatctctacaaaaaattaaaaa

SEQ ID NO: 74 - DNA, 1819 bp, Homo sapiens
  nbla24254
agctaaacttggtgcctgaagaagagaatgaattattgcagcttagttcttcatatacattgaagaatgattatgaaaccttaagtttatcagcattttggatgaaggtaaaggaagactttccattgttaagtagaaagagtgtcctgctattgctaccattcacaacaactagtttgtgtgaactagggttttccatcttaacgcagttaaaaacaaaggaaagaaatgggctgaattgtgcagcagttatgcgggtagcattatcttcctgtgttccagactggaatgaacttatgaacaggcaagcacacccatcatagtaaataaaaatcttacctagcttttgtctttgtatttcttattttgtagtatttttctatgttatatttaaatggtactataatactgtgatacttttgttatgttttaatttttgttatatttaataaaattattttatgttcattgaacaaaaatttaatgaatttctgttagaggccaggaactattctagagacatttgggatacaaaagtgaacaaaacaggtaattccctagtagagtttatatcctggcaaggagaaattgacaataaacctaataaataaggtttataatatttagaagctattaagtgctatggaaagagtagtaagaaggaaggtcagggaagtactggggaaccaaaccatgaagggttctgtagaccattattgggcctctggcttttgtcagtggactagagaacagttgaagggtttaagcgaaggagagaaatgatctgagctaggttttaaaagacactctggtcactattttaaattcttagggtaagtctgaattaaatgttactttcccctcactgggcatggtggctcagacctgtaatccccgcactttggcaggccatggcagaaggctctgttgagcccaggagttcaagaccatcctgggcaacatagtgagaccttatttctactaaaaatattttaaaaataagtcaggtgtggtggtgcacacctatagtcccagctactcaggaggctgtggcaggagggtcgcttgacctcaggagtttgaagttgcagtcatctatgattgcaccactgcagtccagcctgagcaacagagtgaaaccctgtctcgagaaaattaaatgttacttccctaaaaaaaccttttctaaccaccctagggtaaatcctccattattcctttatttctttgttttccttgtatataatttgtaataattttgattactgattgtcattctgccaccctggagtatataatttttaattatctgattactgttattcttccatagtaggggaggtgatatccatttgcctgatacatagtatgtgttcaatacacatttgctaaagaataaatgaatcaataatacctaacatctctaatttgcagtcattcccaagagtaattattaaatatgtggcaaatttctttgcctttttacttttaaaaatctaattttgacataactgctgtaaccatccagaaacggcattgatgttgcttcacgttgctgatgcttaagcaatgtatattgtgtaatatacaatgtagtcttcaaactaatttcaacttctgcctttctgtgtactcccttatcccactgggtgatattatttggcatggtcattgtcattaaaatcatacaggatagtaattcctttccatctgctaccatgcctagccttatttaatttttcagattttctgttctattgaaggtaattgattttttctttttttttaatgcttgaaataaagtgttgaaaaacaaaaa

SEQ ID NO: 75 - DNA, 2512 bp, Homo sapiens
  nbla24327
atgctttagatcaagggttagcaaaccactgcttgtttgggccacggcctgtttttgtatagtgtgggagctaagagtgggtggtgtacatttttaaagggttatgacaacgacacagaataatatgagacacaaaccctatgtggcccataaaacctaaaattctactgtctagctcttcacagagaaagtttgctgatccccgctttagataatgggggtgctctactactccccttttcatttatagtgttacataagcctaaataatcactgtagctggtggcatcatgtttgttacctactaagtaggtcaaagtgattgccagacatacacatgaaggccttgaattagaaagcaaaggaactgatgatgaccaatgtttaacaaaattcagactgactttgtgcctgatccttcaaaggctagaggtgatatttttggtacctgaaacgtaatttccctgataagtactctttgcccaattattgcttatcagctgagatattaatgtctgaattattcagctcatatatcttcaagcactcaactagttcatactttgaaatcaattctaatagacaattctcataacacctttatagtcttcccatttaaaaggtaaatgttgttagggctggaggggtaagatgcacccttggtatattgtctgatctcagcagaatcaactacttggtagtgtagtccagagaaaatgggtcaaatctattaattattttaggattttgaaattcataattgagactcgtgacttaatagtgaactgctcatggtactttacccagtcttcaagttgtatgccttttgtaggtaggcatttagatgggatgcttttgaaagcataattaagaaactttacttgaattttgtttataatgggctaatgttattttcttatagtttgcagtgttgatgtgggtatttacctatgttggtgccttgtttaatggtctgacactactgattttgggtaagtctacaaagccattgggatgaaaaattgctggaaagattgtgtgccaggagcttagacattttagtggagaatattctcattgtatgaaaagtaggggatgaaaatgtgggccgggcgcggtagctcatgcctgtaatcccagcactttgggaggccaaggtgggcggatcacctggggccaggagttcgagaccagcctggctaacatggtgaaaccccatttctactaaaaatagaaaaaattagctgggcgtggtggcgcacgcctgtaatcccagctactccggaggctgaggcaggagaatcacttgagcccaagaggcagaggttgcagtgagcggagatcgtgccattgcactccaggttgggcaacaagagtgaaactccatctcaaaataagtttgaggttgtattctctttaaataagttggtgatactgcttcccggtttattgaaatgctaccttagttgctgaagacagctcctactaacaaacagtgataaaccagataaagggtggctttatatgatggtgcagtcataaatctaaccagggatacctttattttatgaaatctcactgtgatatgatttgaagctagaaatggttcctagctctaataactgcagcctcacacagttcattcattcctctggagtggctcctcaacagcagatgcatccagagatccttatgtttttattcattcattaggaacactgcttggttatcttgagttgccagtttaatagttttttgagtgtttattcctcccaaatcattccattctttttgaaaagttgtatatttcccttttcagctctcatttcactcttcagtgttcctgttatttatgaacggcatcaggtaatttcctaactaactgctgacttcagaatagagcactcactctattacatgggatttacggatgtattagtgcccattttcaatgtcttacaaaaatgagaagtgtgatggtttcttaagcctttagcttgacacatagtagtggttaataagcttctttagcaacggtaataattcctttatacctctctttcaggcacagatagatcattatctaggacttgcaaataagaatgttaaagatgctatggctaaaatccaagcaaaaatccctggattgaagcgcaaagctgaatgaaaacgcccaaaataattagtaggagttcatctttaaaggggatattcatttgattatacgggggagggtcagggaagaacgaaccttgacgttgcagtgcagtttcacagatcgttgttagatctttatttttagccatgcactgttgtgaggaaaaattacctgtcttgactgccatgtgttcatcatcttaagtattgtaagctgctatgtatggatttaaaccgtaatcatatctttttcctatctgaggcactggtggaataaaaaacctgtatattttactttgttgcagatagtcttgccgcatcttggcaagttgcagagatggtggagctagaaaaa

SEQ ID NO: 76 - DNA, 1564 bp, Homo sapiens
  nbla24510
ttatcgatacacagcctctctgagctggagcgtctgaagctgcaagagactgcttaccacgaactcgtggccagacatttcctctccgaattcaaacctgacagagctctgcctattgaccgtccgaacaccttggataagtggtttctgattttgagaggacagcagagggctgtatcacacaagacatttggcattagcctggaagaggtcctggtgaacgagtttacccgccgcaagcatcttgaactgacagccacgatgcaggttgaagaagccaccggtcaggctgcgggccgtcgtcggggaaacgtggtgcgaagggtgtttggccgcatccggcgctttttcagtcgcaggcggaatgagcccaccttgccccgggagttcactcgccgtgggcgtcgaggtgcagtgtctgtggatagtctggctgagctggaagacggagccctgctgctgcagaccctgcagctttcaaaaatttcctttccaattggccaacgacttctgggatccaaaaggaagatgagtctcaatccgattgcgaaacaaatcccccaggttgttgaggcttgctgccaattcattgaaaaacatggcttaagcgcagtggggatttttacccttgaatactccgtgcagcgagtgcgtcagctccgtgaagaatttgatcaaggtctggatgtagtgctggatgacaatcagaatgtgcatgatgtggctgcactcctcaaggagtttttccgtgacatgaaggattctctgctgccagatgatctgtacatgtcattcctcctgacagcaactttaaagccccaggatcagctttctgccctgcagttgctggtctacctgatgccaccctaccctcctccagagagctcagttggaaaggccctcaagaggcatgctagaacgttaggtcagcctactgacagctgacaaacaattaatgcgaaatcatgtcacaccaacccatagccgtgtccacgcagcaactccaccaccttaggatttccccctccaaattattcagaccaatggcttgccaaatggcctctcccaaaattctgtacagttttgctcaggtcacgccaacagggaaacctcaagtgtaggtctaattagtgtttctgggatccaaagttagaggaaaatttagattttattgcctggatctgctttaaagacaattggtgtttacaccctcttgtcagcaaaacagctagttaggtaaggacatatagttccaagtaggtaaagtcacttgattacaaatgttcttaactatcgtctctgtaattcctttatacaggacagtacaaaattgtgggacatgctctggtaacacacagatatgggttgcatatgatccagaattacagctgatattatggatgacaactgctaaggtccataaaatgaagactgtattgtattgagggatagaaattgatcatttaatgggtaacaactgctgagctcaaagatttgtgattgttaaaacttctctggcatttaatcattaataaacatctgtattgtgacagcagcataaaaa

SEQ ID NO: 77 - DNA, 1666 bp, Homo sapiens
  nbla24554
aattttttataatcctcaattatgaaccaccttgtttataggacaaaaaaatttaaccaattttattgaaacgaatttcactgtgtaaaagttggtttgattcaaacatgtagagaagttgtagattcaagatatatgatttctctatggaaataaaaatatttgttagtgaattggttgagttttgattcctctaacttctcagaatgattctttagaattctataattcatagcaatttttgacaagtaagattgcaaaatagaaatatctataaagattccacagtttgacattatggcttgctatgcagatgtgaaaataggttaaataatatgaaagatatggcagaatgtaaagtggaaaagatgacctaaaattttgagttgtattaatagttaaaaacatttgtgtcagatgacagggtgggcttttactgtcaagacatgaataagaactgatctggctgcctgatgagtgtttccacgcagccctgcatatttagtgaccaaggcatcaaggacatcccgaaactggaaattcatatccatctggtatgaatatataactcagctggcaaatgaatgtgtttgttgagatattacagtaataaaacacttaagaacaggaagattacatttgttggcatacgaaaccttagtggctacagaagaaagttgaccttgtgtcactatttattttatgccctgatcagactagcaacttagataagtgaaagtttttctaacatgccttaaaaatattatggtttgatccaaagacccactttttctttagctcttgtgataagattttcttttttttacttttatacaaaggcagcatctttgaatttttttttcttttgatgttgcaacttttgggttcttttaaactgtgatagtgatggtaactgatgcctttcattttgttcaacttacacaaaacaagccagcatctgatcaaaagtattacataaaatattttcttaaactattgaaaggtgctttgatgattttctcctttggtttgtagaattaggactgaacttttgactcaaattgctacagttgccatcacctttctgtggtaatactactgatatttgcttttctatataaagaaatgttgcctaaggctgtctggtatttcttttcaagggttttccagtatgaatgttaatgttgtcagtgtatgtatgaatatgaaagtgctttgttttgtttgttgctgttttttgtttatgtgtgtgtttttaatttttttgttcttatcagcagtcttgtgttagcactgggtaagctttaattgtcccttagccaatcaaacattaaggactatggaggtctttttttttttttatttaacatgtcattgttcatctattaaatcttgatcagggtttcaagaatgactgcagtgggttttggaaacagacttatcattattgatttgaggtttcccagagatatagttcacagttaattgttgcgctctaatacaactgaccatttaaaattgaacaagtttattgttttgtaacaatgtcagttgttaaaccttgacatttcaattaaaacatgaattgtagttataactcaatgcaaattcaacagttgtatttggagttaaattattttaacaaataaatttatttaatgaaaaa

SEQ ID NO: 78 - DNA, 1374 bp, Homo sapiens
  nbla24604
attagctgttactgcagcacagacctgcttgtgtgtgccattccccagatggtaggatataagcttgacttgagaccagcgatggtcagtaacaggctttgaagtggcaggattgcgttaggtgtgctgctgtgatctggtgctgctttgaccttgaaagcaggataacgcatgcacttacttacccccgcattacttgggtaccttaaggactagtggttcacaacttactttaggagcttttatttattctgtaacacgtgagatctggtaagacagtggggggtaaggaaaacagacaagaccatgactcttctttccctcttccccaaaacgtgcctcttggaataatcttcagtgtgccctccagcagagccgaaatcaggcaggcatagactccctcctctctcatcaaaccgcagaaatagagttccttcatcataaccgcaaagcttcctcctcccctttgcaccctgcctcagctgcattttcttgtcgcttctacatgggagtgcttgctgttctgggaagagtggggagaagcggtgggaatccttgagccaattgaaactgaggtcatcttcaggaaaaccatgtcttcctgaagttgaaagattcaggcacaccatacagtcctttcctcatgaataatcttgttctttactcatgggaaattgggagaggttaacccctcccaagtttatgtttgcaaattcatgtttatgggtccaggtgaaaaacttttctgaacacagcatgctacttctcttattacctctctctatttaaagaatggctaggctgagcatggtggctcacacctgtaatcccagcactttgggaggctgacatggcaggattgcctgagcccagcagttcatgactaagcaacatatggagattctgtctatataaaaaagtaaaaaattaactgggtgtggaagtgcatacgtctagtcccaagctacttgggaggctgaggcaggaggagttggaggctgcagtgagacgtgattgtgccgctgtatccagcctgggtgacagaaaaagaagagacccttcctttaaaaaaaaaaaaaaaaaaaaagccgggcgtggtggctcacgtctgtaatcccagcactttgggaggccaaggcgggcggatcacctgaggtcaggagttcttgagaccagcctggccaacacggcaaaaccctgtctctactaaaatacaaaaattaactgggcatggtggtgcacacctacaatcccagctactctggaggctgagacaggagaatcgcttgaacccaggaggcaggggttgcagttaggtaggatcgtaccactgcactccagcctgagtaatagagtgagactccatctcaaaaa

SEQ ID NO: 79 - DNA, 2478 bp, Homo sapiens
  nbla21037
aaaaaaaaaaaaaaaaaaaaaaaaaaaaaaaaaaaaaaaaaaaagaagcgagggctcgggatcgacggccgcggggcgccgacgaggagtgcaggactcaggaagggcgagtgcgcggcgacagagcccggggaaggaggcagggcaaggccgggcttgggggcaggtggtccgggcatccagccttgaagatgcacaagaggaaaggacccccgggacccccgggcagaggcgccgcggccgcccgccagctgggcctgctggttgacctctccccagatggcctgatgatccctgaggacggggctaacgatgaagaactggaggctgagttcttggctttggtcgggggccagcccccagccctggagaagctcaaaggcaaaggtcccttgccgatggaggccattgagaagatggccagcctgtgcatgagagacccggatgaggatgaggaggaggggacggatgaggacgacttggaggctgatgatgacctgctggcggagctaaatgaggtccttggagaggagcagaaggcttcagagaccccacctcctgtggcccagccgaagcctgaggcccctcatccggggctggagaccaccttgcaggagaggctggcgctctatcagacagcaattgaaagcgccagacaagctggagacagcgccaagatgcggcgctacgatcgggggcttaaaacactggaaaacctgctcgcctccatccgtaagggcaatgccattgacgaagcggacatcccgccgccagtggccataggaaaaggcccggcgtccacgcctacctacagccctgcacccacccagccggcccctagaatcgcgtcagccccagagcccagggtcaccctggagggaccttctgccaccgccccagcctcatctccaggcttggctaagccccagatgcccccaggtccctgcagccctggccctctggcccagttgcagagccgccagcgcgactacaagctggctgccctccacgccaagcagcagggagataccactgctgccgctagacacttccgcgtggctaagagctttgatgctgtcttggaggccctgagccggggtgagcccgtggacctctcctgcctgccccctccacccgaccagctgcccccagacccaccgtcaccaccgtcgcagcctccgacccccgctacggcgccctccacaacagaggtgcccccacccccgaggaccctgctggaggcgctggagcagcggatggagcggtaccaggtggccgcagcccaggccaagagcaagggggaccagcggaaagctcgaatgcacgagcgcatcgtcaagcaataccaagatgccatccgagcccacaaggctggccgagccgtggatgtcgctgaattgcccgtgcccccaggtaggccttgcccctgtaggcctcgccccagtaggccccgcccccgtaggccccgcccccagaggccccgccgctggcaggctgtgccccaagctcctgttcctccagcctctgagccttggcagatgctattactccccatagcacaggctcagggagctgaatacaacatattcaagggttttgtaaacttgttaatcagtgggagcttgacattggacatgatgtgtctgcactgtagaaattggcaaaccggctggacgaggtggtcatgtctgtaatcccagcactttgggaggctgaggtgggaaaatcacttgaggccaggagttcaagaccagcttgggcaacgtggcaagaccccgtggctacaagaaatttaaaaattagcctggtgtggtggtgcacacctgcagtcccactctagatcatgccactgtactccagcctgggcaacagagcgagatcctgtctcaaaaaaaaaaaaaaattaattaattaaaaaaagtaaaggcccaagactctataggtgggagaggaatctgcatctccaccataatggtgtgagttggtctccatcctgacacacaataaccaggcctcgactggccacccaggcttccccccaatccagggcctggaggccaccaagcccacccagcagagtctggtgggtgtcctggagactgccatgaagctggccaaccaggatgaaggcccagaggatgaagaggatgaggtgcctaagaaggtttgagggttggggccgggcgcagtggctcacacctgtagtcccagcactttgggaatccaagatgggaggatcgcttgaggccaggagtttgagaccatcctgggccacacagtgagacccccgtctctacaaaaaaattttttaaaattagccaggcatggtgggactcacctgtagtccctgctacttgggagactgaggtgggaggatcacctgaactaaggagttcaaggctgcagtgagccatggtcatgccactgtacgccagtctgggtgacagagcaagacctcatctccaagacaattaaaaa

SEQ ID NO: 80 - DNA, 1337 bp, Homo sapiens
  nbla21161
taagggaaattgtcattaatgagtcaagaaactgctcatttatggtaagaggaatacagcggcgctggcagcccaacagtgctgggatatcatttttaggttgccttagctgcttgagtgagacaagtttctttctgtggtggtggattgtggcagaaaaaaaaaaatcatgcatgactgggagactcgcctgcctgattcttgagataatatattgagaatctgttgctttacaaatgtcacatcactgatgtagcggtcagcccctcactctgaaagatgaattgtactattggaaatgcgataataaggttgacttttcccaacaataggattctgcctttgtctttagagaaaaggcctctgaggacatttgtgcatttgtttgaggattctgttgaaagactttaaagtggaggtttgtggaaaagtgatcaatatacaaaatgcatgaatttttagcctagcaaaaccagctagttatttatactgtatatacagctactattttggaaaagtggccagaataccttttaatatacctaatgttaatttatggttcaataagtgtactgaggttagtatggatgggagaaaagggtttttaaaatttttatcttttataacctccagagaaatctaagtaaatattttgttccaagtgagctgtttttatttgtgtttgtcagcattgtcttaatgtttacttttcacaatattttaatattggtgaaattgcactcagagtttatgttgttgatttggggcacacatacctactctgtgtatatatgctgaaccatttagaacactttaacctgtgaattcaccctcagtacacagttcaacagatactgtagtactattgtgactcacaggacattttatacatttgctaaagaaattactttaaaagtttacttaactgagtattgttccaccttaaggaattatagttttaacatttgtacttttctatttcatgtattttcatttctaatagctgaacgtattcatactcaagtctaatggattatgcagtgtacccaacacatattgttttatgatgtatctgtattttctgaagtgtgaatatatatgtatgtttatatgtgtgtgttcatgaaacagcatcttggacagaatagttttaatcttgaaaaatgtaaggttattttctttcctaataatttttcacaaacccatttattcttggactttgaaacccagaaatatagcttattttttggtctgtatgtctactctgcctagttctgtctcactgtcaactctagtcaaagattaaagattacattgaattttgtatttggtaaaaa

SEQ ID NO: 81 - DNA, 3268 bp, Homo sapiens
  nbla21170
atttgggtcagcagaaacggcacgattgagcagcactgtgactataggatcatggatcagaggctgcttcctctttggttctgggcatcagcctcatgtccactcaaagtaagtggcccctctgattggaatcggaggtgcctgggtcatctcacagagccaaacaaatacaattagctattgcaaagccttttgggaattattcccagtgtaaataaacacataaccatatagcaagagccttgataaagtccaaaaacatgcaaacttggagtatctaagagaaaagaccacaatgtaaatgaaaaaccaaataaactcgggcaaaccataggatagggccctgtctgtgatggcctgcatatgatgagccatagaaaaaggatggtgaattctggataataagaaatgtcaatgagatggaagaaccacctgttttatgtaaagctccaaataaccagatcacagtggacagccactcaaataatgccttcataatacagagtattattgagaataactcaattcacagagagcttaaggcagccaatatttgatagcctgtcagaaaaaaacagaacagtaattatagaaaagaatcatatcctcggaaaaacaaaaattaatcaaactaagtttgtaaagtctatcttacagacacattgtctggactggtcctctcaaaaatacggtttttttttaatgccaatttgtttagttaatgatttttgtcttattacttcaaaactggaaatatcctatgactcataatatcttacaacctttctactttcttaaagaatctcaagtttataatcacaggggatcggattatttttcaaaaattaaatggtgatgtaatgatttctgtgtctattgtagaaaagtcaaccttattacagctgcaacaatggcattaagaaatatgagtaattccaatcaacttgagataatgtctaatcaaacacaaatacaactggtaaatttcattaaatagcatggagattaaattaaaacactattatgtaataaaaacctttagtggtactaaaattttagaatagttcagatatacagaaaaatttcaaagatacacagagttcccatttttttcctattactaacctctcatatttgtcacaactaatgaatattcaatagagtattattaactaaagcctatacatttatttagatttccttagtttttagctaacattctttttctttgttccaggatcccatccgggccaccacattgaatttatttgtcattttaggtacctcttggctgtgagtttcttagactttccttgtttttggtgaccctgacagtttgagggagtactagtcagtcagttatttttgcagaatgccctaaatttgagtttggctgatgtttttcttagggtttgactggggttatgggttttggggaggaagaccacagaggtgaagtaccattctcaccaaattatattaaaggtacataccatcagcatgccttatactattgatgtgaactttgattgcctggctgtggtagtgtttgtcatgtttcttcactgtaaagttactcttctcatcacccacttttctgtactgtactctttggaagaaagtcactatatgcatcccaaatttaaggagtgggaagttatgctccacccatttgtaagcagaaaatctacataatttgtttggcattcttctgcataggaaaattatctcactctcccagttatttatttatttgatctttttttatatcagtatggactcatgggtatttcttttatactttgggttataatccaatactaacacaataaagaaatttttaatggagatgcattcaaattcgttgctaaaatgggcctgacacctcttgaccttggctaaacagagattctggatggagcaaagcactgtgacgtcatgtggactttgaaggttaagaaactacggatcatcaggacatatttgctcttccatctcacagagaaaatggggatatacctcctcattccaggaaactttcttcctatatttctaatatatccaggataaaattcaatatatatagtcagtagcttcaaagttaagcataatttgtttactagaattcttaaggcagatgttggatcattaactcattctcttagaaataactttggtgcttataagtaggcatcacataatctgatacactgatattatatatataatcgtgaaaaacatatcggattatatgatatcacataatctgatatatgtgatatataatcagattatgtggtatcatataatctgatatataaatgtttttcataattatacatatatttcaagtataattgtgaaaaacatttgccagtttaaagtttaatatgtagacagaataatgcctggaggtatagggatataattgggaattagagtaataaaataaatattttaagtacttactacatattactcattaacacaaaagtaactttacgtataaaatgcatgacaagactccattataaagaagtgtctgaaagctatagggcagaaaggtatagaacacagtatagactagaaggagataaagacaatcagaagattttattcattcatttattcaacaaaaatttacagagtacctccaattatcagcagctgtgctgaagattaggtatattacctacacagttacaaattttgctttcatgtagtctgcaggaagagagacattaatcaaagaatggcactattgacacttgtgcaggaaagggttacgtcaacaggcctgggctgctcaaaccttgcgtattcccagagtctcaagactggtcttggcctggctcctgggaagattacttctgagcccttggctgagataggagtttatgccaacagtgtgatttatggcaaacacctgtttttgtatgcctgaggctttggatcatgctgtaccaatttgatctgaggcctgaagactggtagctaaggtgctgcatgcctacatgactgacctccagtaaaaaccctggacacatgcctcaagtgagtttcgttggttggcaacactttacatatgttgtcacacgttgttgctgagaaaattaagtgtactccatgtaatggcactgggagaggacaactggaagctggtgcttaatttctcctctactccacgctatccaccttttcgcttcgctgagttttttctgtatcctttcaatgtaataaactttaaccatgagtataacagcaaaaa

SEQ ID NO: 82 - DNA, 1304 bp, Homo sapiens
  nbla21198
gataagcagagctgtttcctctggggaagggagggaggtggggtgcgggtgcggagggctcgcgctgctgggcacccatggacctcagccacggcgggcccagggacggacctccaggaggcctgctgggggaacaggtgcggggcatcactggggctggaggccggggtgctggggcccccatacccttggcctggatcaggcctcagaggagccattcctgtccatctgagcctgctctgggcctcccgggacactgcctttccaccttgctctgcagatccagcctccatcccaccacttctcccccgagcagcgggccctgctctacgaggacgcactctacactgtcttgcaccgcctgggtcatcctgagcccaaccatgtgacggaggcctctgagctgctgcgatacctgcaggaggccttccacgtggagcccgaggagcaccagcagacactgcagcgggtcagggagcttgagaagccaatattttgtctgaaggcaacagtgaaacaggccaagggcattctgggcaaagatgtcagtgggttcagcgacccctactgcctgctgggcattgagcagggggtaggtgtgccagggggcagccccgggtcccggcatcggcagaaggctgtggtgaggcacaccatccccgaggaggagacccaccgcacgcaggtcatcacccagacactcaaccccgtctgggacgagaccttcatcctggagtttgaggacatcaccaatgcgagctttcatctggacatgtgggacctggacactgtggagtctgtccgacagaagcttggggagctcacggatctgcatgggcttcgcaggatctttaaagaggcccggaaggacaaaggccaggacgactttctggggaacgtggttctgaggctgcaggacctgcgctgccgagaggaccagtggtaccccctggaaccccgcactgagacctacccagaccgaggccagtgccacctccagttccaactcatccataagcggagagccacttcggccagccgctcgcagccgagctacaccgtgcacctccacctcctgcagcagcttgtgtcccacgaggtcacccagcacgaggcgggaagcacctcctgggacgggtcgctgagtccccaggctgccaccgtcctctttctgcacgccacacagaaaggacagtttggctgctgtgtctgctgcgcacgccccctccccggacagcacctgccacctagaaactttcttagcaaaaaaattaataaaaacaaatccattgtcctcttaaaaa

SEQ ID NO: 83 - DNA, 1656 bp, Homo sapiens
  nbla21298
gatggacagttggtcccaggcaaccgtatgacttccactaacttggccttggtgtttggatctgctctcctgaaaaaaggaaagtttggcaagagagagtccaggaaaacaaagctggggattgatcactatgttgcttctgtcaatgtggtccgtgccatgattgataactgggatgtcctcttccaggtgcctccccatattcagaggcaggttgctaagcgcgtgtggaagtccagcccggaagcacttgattttatcagacgcaggaacttgaggaagatccagagtgcacgcataaagatggaagaggatgcactactttctgatccagtggaaacctctgctgaagcccgggctgctgtccttgctcaaagcaagccttctgatgaaggttcctctgaggagccagctgtgccttccggcactgcccgttcccatgacgatgaggaaggagcgggtaaccctcccattccggagcaagaccgcccattgctccgtgtgccccgggagaaggaggccaaaactggcgtcagctacttctttccttagatgtttttccttctataaggtgccagacaggggaaaagggtgggggtacatctgggatgtcacaggaaacattaaggagagagttgaaggtaaagatctgaaggtaagaaggagttccacctgatgctcgggtcaggatgagaattccaaacacactgccagccccttcactggggatgcttggtctcttctgctggtaaaagcagagatgtttctgtgtcatgcccaagctccccggtgctaccttgcctttctcttttacccctgatcttggctttctctctctctctgcagactttcctttaattgatgtgacatttgtggtaaacacctttcccagggaacctcacaaatcttgagatgctttcccttccccagatgggattgcatgatttccctgactttcctaccctcctccagagagctcagttggaaaggccctcaagaggcatgctagaacgttaggtcagcctactgacagctgacaaacaattaatgcgaaatcatgtcacaccaacccatagccgtgtccacgcagcaactccaccaccttaggatttccccctccaaattattcagaccaatggcttgccaaatggcctctcccaaaattctgtacagttttgctcaggtcacgccaacagggaaacctcaagtgtaggtctaattagtgtttctgggatccaaagttagaggaaaatttagattttattgcctggatctgctttaaagacaattggtgtttacaccctcttgtcagcaaaacagctagttaggtaaggacatatagttccaagtaggtaaagtcacttgattacaaatgttcttaactatcgtctctgtaattcctttatacaggacagtacaaaattgtgggacatgctctggtaacacacagatatgggttgcatatgatccagaattacagctgatattatggatgacaactgctaaggtccataaaatgaagactgtattgtattgagggatagaaattgatcatttaatgggtaacaactgctgagctcaaagatttgtgattgttaaaacttctctggcatttaatcattaataaacatctgtattgtgacagcagcataaaaa

SEQ ID NO: 84 - DNA, 1800 bp, Homo sapiens
  nbla21379
gcagctgcaccgtcctcctccgccgccagtcgtccgccgccatggacgtgtaccccccgcgccggcaggggctgccccgcgctcggtcccctggcggctccagccgcgggtcaccctccgtcagctgcagtcgacttcggcaggttcagagcatcctgacccagagcagcaagtctcggccggatgggatcctctgcatcctaggaatcgatagcaggtacaatgaaggctgcagagagctggcaaattatcttctatttggtttgtacaatcagaataccagtgattttgagaaaacgggattttctgaagaagtactagatgatgtaattatattgattaaatcggatagcgtccatctgtactgtaatcctgtaaactttcgctatctcttaccttatgtggcacattggagaaatctgcatttccactgcatgaccgaaaatgagtatgaagatgaagaagccgcagaagaatttaaaattaccagctttgtggacatggttcgagactgtagtagaattggcattccttacagctcccaaggtcacttgcagatatttgatatgtttgtggtggagaaatggccaattgtacaggcctttgcacttgagggcattggaggggatggattttttaccatgaaatatgagttgcaggatgtgagtttgaatctatggaatgtctacagcaagatggatcctatgtctctggagagtttgctttcagatgatttggtggcttttgaacatcagtggactagcttcttcgctaattttgacacagaaattcctttcctgctagaactttcagaatctcaggcgggtgagccattcagaagttatttcagtcatggaatgatctctagccatataactgaaaacagccctaaccggcagccatttgttctctttggtaatcactccacacgagaaaacctgaatgctggcaactttaacttcccttctgaaggacatctggtacgaagcactggtcccggcgggagctttgccaagcacatggtagcccagtgtgtctcaccaaagggacctcttgcttgttcgagaacatacttttttggagctactcatgttccttacttgggtggtgacagcaagctgcccaagaaaactgaacaaatgtaagtcttcatattttattttttctttctcaaagttgagttactcagttgtgactgtcctgtgtacttccttttgagatcaacagtgattaagacatctgcttttgctgggtgcggtggcgcacactgtaatcccaacattttcggaagctgaggtgggaggatcgcttgagaccaggaattcgagaccagcctgggcaacataagcagaccctgtctctacagaaaataaaaaattagccaggcatagtggtgcacacctgtggtcccagctactcaggaggctgaggtgggaggatcacttaagcctgggaggtcgagatttcactgagctatatgattgcaccactgcactcttggcaacagagggagactgtgtaaaaaaaaaagaagaagaagaagacatctggtttatgacatgaacattactgtgttgtttcccaagtttctctcagcttggaattcaggccagagaaccttgccagctttgccatctgctcttctctctagatttcagagacttcttacctgcacacccatgcatttatgatgtaactctccttgatatgttttctatataatgcatttttaaattaagggcttttctaagaataaaccatcctgaaatccattgggagaatcatgtgaaaccccaaaaa

SEQ ID NO: 85 - DNA, 2150 bp, Homo sapiens
  nbla24705
agaaaaaaaaaaaaaaaacaaaaaaaactaaaggaaggaaaaagctgtaaaaatcactggcattcgtggggccactccccacccaagctccacgtgtgtccgtctgtgctcctggcctctgggggaccagctgggacatgaacttgtctgccaggcccccgtcgcgtgctgaacggtgttagtttgtaggtaacgcacacaccccacacctaaggtgtctgcatcctcctgccaacgcatgggctccacgtggtgtgctcgctggctgtcgtgactgtcagctgtctcttgggaggggctgtgggggcccgctgggctgcctcctttcccgctagttgtgcctgagagttgctgttgttcctgctttcccttcccttcctttcatcccctgaagggctaggtgtgggttttccgtgcccggtatccccacacacccagcacggacaacccttcggcagagcccaggccggcccctcaccccctggagtattgaaactggagtcccgtccccaaggccttcagagatgcccctacacacccagggctccagctctggtccttctgggggagtaaagtgcaaagaggggcacagcttagttttgggcctctcgccgagcaagagacagcactgctggctacagctccaacacagccagctgtggcaagaggactctgcctgggctggcccccctcctgtgtgaggtgtctgtcccttctctgctggccagcagcagatgcactggcagctcccaaccctgtttccgcccctcggccctcccccagcctgttcggcttctctgcagcccgcaagggggagcagacttttgacaaaggactgcgggcctcgctcaagtccctgagcccccagctgaagctgggaggggaggccaggctttgtgtctgggcatattcgtctgctgatggggtttggggaagcctggggcttggggtttggtcgggtggtgcagctagtggcagagcgggatcagaggtggtggctgcccagcttctgggctgagacaagggtctgtgcaggggtttactgaagtgggagtgcctttggaatctgggccgggagcagaagggagcaaaagctacagtgggagccagcctagggcacatgggaggcgtgagggcagtgctgcccgtgcagtgtcaggtgtgccagtgccttggcgggctgcagtgcgtgtgagggcaccttctaggtgggccagggatgcagctatggagataaggcgggctggggacagaaacaggtgggcacagggcccaggacaccagcggatggagggcagggtctagccctgtgctcctgagcgtcggctgcctgggttcgaggcggtgggtccccggccccttgtgatggtgtgtaccatgggggagctcggggacagggcaagcccgagcatggtggggctgcagggtgggtctgaagccaggttgggtgggggtggtcacaagccctgactgcagagggtcaggggctcctgccccagtgcctgcccactttcaattcacattgttttcaacaaggattttctttatcttcccctacaaatcaagccaagggaggggcacagaatggggaacaggacacaggatcctaaactccaaggggactgtccaccgatgaacactcagagtggacaccatcttccgtccacgctgtgcccaggacagctgtccccatccatgaacacagggtaaacatctgccgggctccgcaccagtggctccctgggccatgggacagcggcagggctcaccacggacagcacgtggcccagcagccggccaccctggcgtcctggggcctcctcccctcctctccctctcaccttgtcacctccacggagctgcctgtctgggataatttggggattttttttctgggggataattcttttgcatgacccctaaagagcaagccacaccggtctgctagctaggtgtccgcggtgtggtggtggcggccgctggccagcgctgcaaggggtcggctgcccacggtgctggctggcctcccctcctctctctttttgctgagtttcattgtcttttctttctgagccttgtaagtgtacaaaaattattcttattttgttctgtctcgggaaactgcaaataaaagaaaaacaggacaaaaa

SEQ ID NO: 86 - DNA, 1732 bp, Homo sapiens
  nbla21385
aaaacacttactgtatgttatttgagtcatttgatattcacttaccctgagaggtaagttctgtttatttatgtggaacctgaggcttagagaacttaggtaacttgcccaaggtcccacagttagtgacagagctagtattcaaatgtggagcagtctgattccaagcatcgcacctttaacctttaatttcaacatcagccttattatgcactacttttcatatactgggttccagctaaactgcactttcctttcgtatgctgttgcattgccattcctcctctccacactgccccttctcttcatttgtttgttgaatgctataagaatcttcagattgatcatcattgcttgctgaaaagtcgaaataatagactttgctgatactcagtaaaagaagaatgtgctaaaattaacaggagacacaattacctacaaatttcactagtttaggagctttgataagcatggttcacgttgtaagaacatgcttcttaacaagagccaaaatgttctcttctccatttgctgattctgccttctcttagtttccatcgctattgttctgggcttcacatgtggcttgaaattcaccctatcctgtattgcagtcacttgcaggcatctcttcttccttgttagattgtaagctctttcaagacaatcactttttaaaaaatccttttgtattttctcaaaacagtagattcttgtatagtaggttgtcaatgtttgttaaaggatggtttatttattccactctgtaagatttgagtgaatttttcatgaaagccaaacagatctttgttttgcagaagagtatcttgtttctgaagatgccaagaaacaaatttgatcctaagagtggtcctttacgataagtgatgtatataagatgacttttttttttttgagacagtttctcactctgtcacctaggctggagtgcagtggtgccatcagttcgctgcagcctcgacttcccaggcccaaatgatcctcctaccttagcctcccgggtaagctcggataacaggtgtgcaccaccgtgccttgttttgttttgttttgttttttgtggaaatggggtctccctttggtcttgaattcctgggctcaagcgatcttcccgccttgcctcccaaagggctgggattacaggtgtgagccattatacctggccacaatgtgacattttaaaattcttatacataattagctttttatgtgttccaaattaaaaaataaccatgattctaataattaagaagtgggaagttttgttcttgtggggaaagtagaagttattattgtagaacctaagaagtgatatttcctggtctaatacctgtatctgattcacttccacataaatgaagttcaactcttttgcccaggagttttgcatcccttgctttggctgagaagaggataaaacctagaaagaagtctaagcaagaccgggtgtggtggctcactcctgtaaccccagcactttgggaggccaaggtgagaggatggcttgagtccaggagttcaagaacagcctgagcagcatggcaaaaccccatctctacacaaaatacaaaaattagctggacgtcgtggtgcacacctgtagtcccagctactcgggagactgaggtggatcactcaagcctagggaagtggaactgtgattacaccactgcactccatcctgggcaacagagtgagaccctgtcaaaaa

SEQ ID NO: 87 - DNA, 2482 bp, Homo sapiens
  nbla21416-1
gcttccggtccgtcgcctccttctgttgcttcccgtctcctcggcggctcccctcccccgcccggctctccgcgccccttctgggcggcggggcggcggagccgtcggcgtgcggccctccttgcgttcgtgcgtgcgcccgtggcccggcgcacgtcccgcgacaccgaggccgagcggggcagggggctgaccgccatgaccccccagagcccggcgtgagggggccgagatgcggtgacctgccagcacctgccgcagccttcgtccgggagtcgccccatctctccacgcatcggggccctgtgccccttgctgctgcagccgggcaccatgtcgacctcgtccttgaggcgccagatgaagaacatcgtccacaactactcagaggcggagatcaaggttcgagaggccacgagcaatgacccctggggcccatccagctccctcatgtcagagattgccgacctcacctacaacgttgtcgccttctcggagatcatgagcatgatctggaagcggctcaatgaccatggcaagaactggcgtcacgtttacaaggccatgacgctgatggagtacctcatcaagaccggctcggagcgcgtgtcgcagcagtgcaaggagaacatgtacgccgtgcagacgctgaaggacttccagtacgtggaccgcgacggcaaggaccagggcgtgaacgtgcgtgagaaagctaagcagctggtggccctgctgcgcgacgaggaccggctgcgggaagagcgggcgcacgcgctcaagaccaaggaaaagctggcacagaccgccacggcctcatcagcagctgtgggctcaggcccccctcccgaggcggagcaggcgtggccgcagagcagcggggaggaggagctgcagctccagctggccctggccatgagcaaggaggaggccgaccagcccccgtcctgcggccccgaggacgacgcccagctccagctggcccttagtttgagccgagaagagcatgataaggaggagcggatccgtcgcggggatgacctgcggctgcagatggcaatcgaggagagcaagagggagactgggggcaaggaggagtcgtccctcatggaccttgctgacgtcttcacggccccagctcctgccccgaccacagacccctgggggggcccagcacccatggctgctgccgtccccacggctgcccccacctcggacccctggggcggcccccctgtccctccagctgctgatccctggggaggtccagcccccacgccggcctctggggacccctggaggcctgctgcccctgcaggaccctcagttgacccttggggtgggaccccagcccctgcagctggggaggggcccacgcctgatccatggggaagttccgatggtggggtcccggtcagtgggccctcagcctccgatccctggacaccggccccggccttctcagatccctggggagggtcacctgccaagcccagcaccaatggcacaacagccgggggattcgacacggagcccgacgagttctctgactttgaccgactccgcacggcactgccgacctccgggagcagcgcaggagagctggagctgctggcaggagaggtgccggcccgaagccctggggcgtttgacatgagtggggtcaggggatctctggctgaggctgtgggcagccccccacctgcagccacaccaactcccacgccccccacccggaagacgccggagtcattcctggggcccaatgcagccctcgtcgacctggactcgctggtgagccggccgggccccacgccgcctggagccaaggcctccaaccccttcctgccaggcggaggcccagccactggcccttccgtcaccaaccccttccagcccgcgcctcccgcgacgctcaccctgaaccagctccgtctcagtcctgtgcctcccgtccctggagcgccacccacgtacatctctccccttggcgggggccctggcctgccccccatgatgcccccgggccccccggcccccaacactaatcccttcctcctataatccagggcggaagggggcctggctccatccggctgccccattccggctccctgggagatcagtgttgtgagtgcatgtgaaatgggggatccccacccccagtgcccttccccttcctggggcccactcacactacaccctcttcctttcccaccccacctccccggagagaaactggacatggggcctggggaggggagctggccagaggaggacccctttcccgtggcattagaagggggaggggtggctggggcccccacccattccccctccctccaaactcccaacccccagtcagtgtttgagcctcctcgttcccctcacgcacccgctcacgcaccctcggtgaatccttggtgatgattttggcaactttgggaataaatggcaattcccacgggcttggcactcccaaaaa

SEQ ID NO: 88 - DNA, 1343 bp, Homo sapiens
  nbla21599
gtaaaaagcaagcatagagactagagagttgggagatgtaaggaaagataggtataatcacagctaagtcatgatgaggtaactggtgacttttttgacatagtaggtacttagtaagtatttgattgttaaacagaaaatgggatatcttgaagtttgtagttgtagtcttaggtctgtctctctatttctaactcttactgtattatgatacccaaaacagggaaccatatcacatttctttgattttaacttgcacagtttttaaattaacagactttatttttagaacaattttagatttatagaataattgagcagatactacagagaatttccatatacctcatataccaccctcattccaactcaatctccccattcatggtgttctctgatattaacatgcattagtgtggtaagtttgttacagttaatgaacgaaaattgatacattgttgttaactaatgttcataacataataaggttcactatttgtgttgaacaattctatgtattttgacaaatgcgtaatgtcatgtatctaccattacagtatcatgtggaatagtttcactgaccgaaaaaccaatatgtgtcacctgtttatccatacccctgtcagccactgatctgtttcctgtctctgtagtttttgctttttccaaaatgtcatatatatagccatgtgttgcataacgatgttacactcagtgacaattgtatatatgatggtggtcccaaaagattataatggagctgaaatactcctatagattagggatgttatagctgtcataacatcatagcatcttatagattagagatgttatagctgtcataacatcatagcatcttatagattagggatgttatagctgtcataacatcatagcatcttatagattagggatgttatagctgtcataacatcatagcatcttagtgcaatacattattcacatgtttgtagtaatactagtataaactaacctattgtgctaccagttgtctaaaagtatagcacatataattgtgtacagtacataatatttgataatgataacaaatgactgttactgtcatatatttattagaatacacattttattattttagagtttattccttctacttatttaagaaaaacagcctcaggcaggtccttcaggaaatattccagaaggcattgttatcataggagatgatcactcagtgtgtgttactgtccctgaagaccttctagtgggacaagatctagaggtggaagacagtgagattgatgatcctgatcctgtgtaggcctaggctaatgtgtgtgactgtgtcttagttttaaaaa

SEQ ID NO: 89 - DNA, 1484 bp, Homo sapiens
  nbla21681
taggagcaatgactgttgggcaggatggcagcagatgaaagctcacagaacactttgcggctccagttcaaggcaatgcaggagatgcagcacaaatggttacagaagcagatggagaaaaagagggaaaaagaactgagcctcaaaagcagagctgacgaccaagaggagcccttggaggtttcagatggcctcagccttctccacgcaggggagccaaactcgaaaaatagctttgagaagagggtgcttgaagatgagattgaacaccttcgaaatgagctcagggaaacggtggacgagaacgggcgattgtataagctgctgaaggaaagggactttgaaatcaaacacctcaaaaagaaaatgaataggttacttgtgtattaaaggaccctttcaaaggaaaatgctcagacttgggacacaggcccagctggttcgttatttatttttatttacatagcgaattctctggcatttgtcttccctgctggaaccactcagactggccaagatttccaaaacagtgttctattgtggaaacaagtgccagagacttggtacgctggatcgggtttctgtgacaggcttcagaggggcccaggtcacaagctggagcgtattgtttctgcctcaaagccttgaggttgggcctgagtgctgcacttcaacaaccgcaaagctgggtccttcttggaccacagcaccccaactgacattcagtagcccaccttttgctgcactcagaggtccacttgtccgtgggttttcacaaaggctagggtcctgtggtgatgtacttcctatagccagaattagctcagcactaggtgacaggtgagtgggttaaggaagcaggagttggtcagctttgtggttcagtcatcccagaatatgccaagccaccgagggcccagatgggagacagagcattgctggagaccccagaggtgaaggccctgaccaggctgtcagccaagggggccaccgacgcaggagccaagccaccgagggccagggacctggaggggtcgggctcaacaaattcttgttttgcagagcaaggtgagtgagtcatcagacttctcctggcctgaacaaaggatttaaaacaccccagaaagagctgccctgacccccttagagacctaagcacacagtacccaaaaaaggcctttaggtctcacagtgcactcgtgcggggttgttgttttaccttctcgccaaccagcctgattttaatttgttatttaatgaacaagctcttatataacacttagcacatgccaggcactggagcttaacaaatgccaacgcctttggtttgatttattttactccaggcatcttttttttttcttagtttatgtagatttgcgtgactgttgtaattgtaagctttttccagttttgtccagatgcttgtagtcttttgaaagtttaattacccaataaaaatttagccttgtctccctcaaaaa

SEQ ID NO: 90 - DNA, 1479 bp, Homo sapiens
  nbla21878
taatcattgcagttaagagaaatggaaattagttgtgttaatcttgcagaatgtttgcaggactgactatcaaactggatgatttccatttataccctactgtgtcagttcaagcatcaaaataccttgcatctgagacagacttcctacatcagggacaggtatctgtgtgtcattatacaaaacagttctagggggttgaactacatagtaaaaaaataaaataaatagtacttagtgtaaaataattttataaatgatcttttgtactttaggacattaaattgtacaacttttgtatatataaaagcttaggaactttctgtttagcaggaaggcaacacattcctacacttttaatgtatatgtttgttataatgtccatgtaaacatgccctatgtttgtgccttttaattagtttgtctcaataaacaaaatgtagagaaaaatatgtagctatgactttgttacaactgttcttatccacagtacaaaaatggtttgtttttaatatgtagagcattatgtgtggactactggaaggactcgtgtggggagagcccaagaatgaccttgctgaggcctggattgggaggcacagtggccacatttggaggaagttcacatttcctggcatgcagacccaaaactgggttctggctctgcctgctgggatctgttatctctggtgggctggcagtcataattcacaattcagacagcccaggcttcctccacagtggtccaaggagcagtcctcagtgggggcaggtgtgggccctacccctaagctagaatgtggttgtcagaaccctgaaagtattagttctaaaaaaaaaaaagatatatactagaagtaattgttttatcaattcattgtataataaacaggagtgagacttcattgtatgacttcagttaaaatactattttgtatgcattctttattcacttaagaagcttgtctgcaataataaagccacgtcatgtcttcttttgggagggagagagtcgatggcaggagggggttttgggtgggccactgaaaaggggtaccgaataggttgtgtgatgaaattctgtgtcttggaactggaattgagtttcgatgttgatgaactgattcaaccaggtgttgaaggcacgacagccactgctctacgaaaaggcagagtacgtttttcccttctggttgtaacctggttgagagcttcccctttatcagattggcagctaaacagttgtattagataatccttaaatctgacatccagcctgttacgctctagggctcgctgcttggcctgcgtttgctttttattgtgtatccgttcccctcctacggtgtgctcctgaatgaaggtttctatgtaagcagatgatgattttacctgtcaataccagcactgtattactaacatgcaaaatactgcagatttattttgaaaattaaagttaactggtcacaaatgtaaaaa

SEQ ID NO: 91 - DNA, 1907 bp, Homo sapiens
  nbla21922
aagctggattaattgacaagtgattttttttcccctctgcttcttagaaactcaccaagcagtgtgcctaaagcaaggtggtttagttttttacaaagaattggacatgatgtattgaagagacttgtaaatgtaataattagcacttttgaaaaaacaaaaaacctccttttagcttttcagatatgtatttaaattgaagtcataggacatttttattttatggaatagattttaatctatttactactattaaggtagattttctatggcatgtccattagctatttcatgatagatgattaggggtttcctcaaaacctgtgtgtgaggaaattgcacacagtagcaaaatttggggaaatccataacattttcagaccatgaatgaatgtttccattttttttctaatggaatgtgagagtttatttttattttattctgaaggactttaaggaagggatacatgattttaaaaaagcctgtaagaggtgaaatatgtgatgtttgaagtctctttatagactttttatatatattttttaaaaacactcatctagatgaggtgctttgagcagttctgaaaaatgcagttccaggaaagcaactgctttggttcctaaggaagaaattctaaataatgcaaacttttaaaataagcatctaggtttttgataattctgtctacttacaacaaacttgttagtacataaccactattttaataattattttctctacacaaatgtgtaatatcatatttgactttgcttatgcaggccataagttccaaaagataatttccctgcccacaaaggcataaacttgaaaacacatgagattgaatcaacatgctttaataggaaaagatgtatggtctatatatgtatcaatctggtgaatcctcgttctaataaaggttctttttcttttctatgatacacacagccacgctgataatatgcaaatgaacattttcctttatgtctctccagataatgtttattgtctgaggtaaattaaattcccaccagggtttgctgtcagtattttaacacccacattagtatatgcgtccagggtcataaccccctaaaatccatcatgcaaccttattaatctgtcttgggattccagtttagtgcttggatttatttcctgattacactacatagaaaagtgagacatctgccattcccaactctgggaaaaccaactaatatacaaccatataaatgaaggccatcttgatggtctcaacactaatttttatgatgcaaatttatacactgatttttgtaaaggacaaagttttaaaagcgtatttaacttgatgttttctatcagcataaataaaatggtcatgaatagtcattaaaaacagttgccagtgataatctgcatgaaggaaaaagaaccctgcaaatggctattgagttggaagtattgtttttgatatgtaagagatattcagaatgctcacactgaaaatgcctcaactttttaaagtgtaagaaaccaccatgagtggtgtctagatttctaatgaagaatcatgatacagtttggattaagtatcttggactggttttaaacagtgctttgtaccggatctgctgaagcatctgtccagctggtatcctgtgaaagtttgttattttctgagtagacattcttatagagtattgtctttaaaatcagattgtctcttctatattgaaagcatttttatgttttctaatttaaaaattaatattttcttatagatattgtgcaataaagctgaagtagaatgtgtggtttttgcaaatgctttaacagctgataaaaattttacatttgtaaaattaatatattgtactggtacaaaatagttttaaattatattttaaaaagcttccaaaaa

SEQ ID NO: 92 - DNA, 1402 bp, Homo sapiens
  nbla22004-2
aacatggcgatgcacaacaagacggacacccggcgggagctggcggagctcgtgaagcggaagcaggagctggcggaaacattggcaaatttggagcgacagatctatgcttttgagggaagctacctggaagacactcagatgtatggcaatattattcgtggctgggatcggtatctgaccaaccaaaaaaactccaatagcaaaaatgatcgaaggaaccggaagtttaaggaagctgagcggctcttcagtaaatcctcggttacctcagcagctgcagtaagtgcattggcaggagttcaggaccagctcattgaaaagagggagccaggaagtgggacggaaagtgacacttctccagacttccacaatcaggaaaatgagcccagccaggaggaccctgaggatctggatggatctgtgcagggagtgaaacctcagaaggctgcttcttttacttcctcagggagtcaccacagcagccataaaaagcgaaagaataaaaaccggcacagcccgtctggcatgtttgattatgactttgagattgatctgaagttaaacaaaaaaccacgagctgactattagaagacacattagtgcagaagcttccaggctgtagagccctgcttcccttctctgacctcacaaagataaacatccttcacctgagttcgtggccatccacctctgctctcccagacccagtgcctgtgactttgagtagtttgttctaaatgtggtgacaaacaagtcatttctgtaagacattgggtcttactttatgtcatttttagtaacagaactgcaggaagatcaagacaatgttgtaatcccggcaagttgctaactgtgcgtttctcccttcttagaatgaatgtctcccccaaaactggctggcaccagcttcatctgtgatacccttcaagaaatgttctctggttttgttttatgctgaaagtagaacacaagtcacatttcagatggaggctgtaaatatctggcattttcttatattgttttatgttttcttgtttttctcttgttgtttttatcttattttctttggggtttttttgtaatgcctttgtacagctcatactttcctgctgacatatctgatcatctctttcatgcagttgccaatattcataactgaaaataatctggtttatcataagtaaaatgggaaacttgcctctgttttttgcaaggggaggtaaagagtgtttagtaattacctatcttaaatctttctgagttggtagtagattcatgttcaaggaacaggaaaaatggaaaaacataagtttaaatcagttctttttaaataactttttattcttttgtataaataaaatttcacaggcttcaaattctcatgctttacttttaaaaa

SEQ ID NO: 93 - DNA, 1577 bp, Homo sapiens
  nbla22004-1
gaagttggcattaaacatcaagagataccattcattcaacatatctatcagaagggcacgtccaccatcagcacaatgagatctcatactcaagaggatccttttctatgcaatgacttaggagaagatttcactcaacatatagcattgactcaaaatgtgattacctacatgagaacgaaacactttgtaagcaaaaagtttgggaaaatcttcagtgactggttatcctttaatcaacacaaggaaattcacaccaaatgtaaatcatatggaagtcatctatttgattatgcctttatccaaaactctgcccttagaccacacagtgtgactcacactagagagataacattggaatgtcgtgtgtgtgggaaaacctttagcaaaaattctaatcttaggcgacatgagatgattcacactggagagaaaccacacggatgtcatctatgtgggaaagcctttactcattgctctgatcttcgaaaacatgagagaactcacactggagagaagccatatggatgtcatctatgtgggaaagccttcagtaaaagttctaaccttagacgacatgagatgattcacactagagaaaaagcacagatatgccatctatgtgggaaagccttcactcattgctctgaccttagaaaacatgagagaactcacttaggagataaaccatatggatgtctcctatgtgggaaggctttcagtaaatgttcttaccttagacaacatgaaagaactcacaatggagagaaaccatatgaatgtcatctatgtggaaaagccttctctcattgttctcaccttagacaacatgagcgaagtcacaatggagagaaaccacatggatgtcatctatgtgggaaagcattcactgaatcttctgtgcttaaacgacatgagagaattcacactggagagaaaccatatgagtgccatgtatgtgggaaagccttcactgaatcttctgacctcagacgacatgagagaactcacactggagaaaaaccatatgaatgccatctatgcggaaaagccttcaatcactcttctgtccttagacgacatgagagaactcacactggagagaaaccatatgaatgcaatatatgtggtaaagccttcaatagaagttacaactttagacttcatagaagagttcacactggagagaaaccatatgtatgtcctctatgtgggaaagcctttagtaaattttttaaccttagacaacatgagagaactcacactaaaaaagcaatgaatatgtaagaatcatcagctgtagcgttaacactaaatacaccaaggacaaacatactacaggaatattatgtctgtaatcagtgtggaaaagcctttatttatatttaccactttgctcaacctaaatgaattcaaggtagagagaatccagatgtatttaatgtttatggcacaaacttcagactctaggctgaccatatacaacgtgagagaatgaaactatagatcaaaggaatgtggaggagtcttcatccacagctctgttaaataaatgggagaaatcacatcacgaaaaa

SEQ ID NO: 94 - DNA, 1945 bp, Homo sapiens
  nbla22085
gtaaattatgcaggtgataacatggtttggaactgtttattgggctctttaactgaattttcaaatgaaatgaactatgcttattgctggcacattgatcccatttctggaacatttttcctatttccagagttacatatgttcttttgtcattacccaatttaacctccctttctctgatatgccttgtagccaaagtattaaaggctgatgaacatagacaagggaaatgcatttcttagaaatccgtgaaccctcagttgtatgctttcagtactcgtgttaatatgtttctatggcaactctgaggtcagtggtttagaaatgagataccagtgttaatgaaaagtgtgtgctctttgcttttgcatggcttggcttagtatccaaggtatattagggccacttgaaagcatgaagaccagttatatagggaacaggtttctctcagtggcacattttgctttttctgagccccaaatacattgcctgggcatgaacattgttaccgtaaattgcacatggtcatggactgaattatgtgactttaaaggatgtaactgcccaacatttgcagattctgggtggtctatgtgaccatttgtctcgtatccaaaaaccccggggctattggaacccttccaacactttttcctttgtcatagacaagtttatatataacttaccaagatgttggctgtcctggtgtattgccagacagctgtcttttggttcccattccaaatgtgctgctgtccttctttgcatttcacaatatcaaagaaaccaccacccttcttcctaacagcattttatgccttttattccacattaaatgggaattgtgcctacttaggagtgcccctccaattaattacatgtgtccaagaataatccaagctagagacacaaggtgggaaaacatttcaaaaaaaaaagtcctcttaaggccagtaatttatctgaaaaggtattttatcacaccttgacaccttatatatgagcctattaggagctgcaggtggtttcatagggtaaaatccaagaaaagagaaggatgtgtggggtttctattagaagataattttgttctcattttaccttttcttttatgatccttctctgctagaacaggttaattctccaaatttgttttgttttgttttgttattttttagggaactcttttgcaaaagcaatggtcggatgtaaataacatttaaagtatagtgcacataacttccccggactgttccaatctgataatttgtaaatgctttagagtttttttaattaacacttgtgttgctaaattctatttatgtaagtctgctaaagttttttagcccacttaaaacttaagacaaccatttaaaataatggatgggttactatgagcaatttcgctttcagaacccccttgttttagtatatgaaaaagcctaatgcgcattaatgaggttgaagagactatgagaaatatgtatagtgtatattttaaaacagctttgcttgtattgtgaagatttaaaaacaaacttgagatttttaacgtaactattaacacagttttaacataagttatcccactgggtttaagagcatcttgaatgtataatcctttttgtaacccaggttggtttctacttttaccagtcacccaaacatatttatgtttttagttttatgtactcatttccctttgttttcctcaaacagcatgatttttttgcacatgtagaaattttttaaaagaaagaaattagtacatcattttctctggattttcttcacttccctcttcctttctactaactccttccttaaaggccatatcactccatttgcattatttgtgcaaatgccagggttggtttttatttttatttttgctatttacctaaaaaaagaaaatgcttcagtcaattgcttttttatttaaaaa

SEQ ID NO: 95 - DNA, 1551 bp, Homo sapiens
  nbla22119
ttttgcatcagtaaaatgatttttttaaaaccaataaatcatcaattattagaaatagttgtctcacagtgatactggtttttcttttgtgctgttatgatttaacattgacaggaacactattttaaatccttacgttcaggtgtttgtaacttggccttataattaggctgaattatggcttcaaggtctacaatttatgtgtatggttcacagcctagcttctatttacatttgaaaatacagatttttaccaactttggattcttttttagttatatgtttgtctttcctttttaaattgttcaaaactattttttaatggtcaagttactaacacttgaaaatcagatactgcaccaaatacagtgtttttccgtagtgtttttaatgagtgcacctattactactgtgcgagaattcatgttttaccagtcattgttatattacaaacagacttgcatgattaaccagttgttacacttactttttcaagttggagtatatatgactcagtgcagactggtctctcttatgtgaatgcacacatgcagaaatgcagagtcaattttacatgcccataaagacatttgtaaagaattcagctcttatggtctgttgtataaatgtgtatctaggcactttggaatttgacctcacagatgttacaacttgatcagtcgtttgacctaatttgtggtagctatctgtatgttttgcaatcttaatacagacatgctttccaaaaagattaatacagaaccatcctgccgttttggataagtctatccagctgtggaaagggcaacctgtggtttctctgtactggtgtttaatgggggaagaatatgaacagctttaaagagctgtgtattgtggttactactattaaaaaataagatctgcacgagtctgactggcctttgggtggcctttgtggacggctcgtagctggaaagtgttgatctgggttttctggcattcttttaagttaaaaagttaacatcgggacatgggtttgatcttttgttgtacctgatgacagtgcagagattctccacagctggataaaaatgtcacaaagctacttactgtacatgggcagtatcagatttcaaatcctaatatttcagctgtgcttttaatactcaaaatattaggggatggggtgttgaagctttcccttttttgcttttaacaatttatagaatttaacagatgtactgtctttcatgtggcctcacatttaaagttatgagaacatacacatggtttacaacttttactatatacctttccttggccaccaagtattttaaaagtgtgccaccttttaacctttactttttttaagttgaaggtgatactttttctatatatgatgaaactcatgtcaactgaagtgagtgtaatctcagataccaacattattatattttaaaatcacgctatggaaatatcacctgaattctgtcatttgtcagatttacagtacctttttttctttaacttttagcattaaataaaaataaaattgggagcactgaaaaa

SEQ ID NO: 96 - DNA, 2151 bp, Homo sapiens
  nbla22149
aaaaaaaaaaaaaaaaagaagaagaaatctcagcaggctgagatggaactcattcttctcatgaagaacgtggcaagcattatacagaggggccatagtctggaaagcaggagatgcttacagacatataagttgtttccagtgttttgctcttggtactcatggttccactatttacatcaaccttttgagaaacatatttatacactgtcttatacttccctcctttgctacagaatgaatctacttgtaacctaccaaaaatttaccctgtcacatttccccagctgctggtttaaaaataaatatcctggatttaaagccaattgtgtctaacaggtgccaccatccaagtgaggatttcactgttcacaggcatttgagacacaccagcggccggcggttctcactgctcttcatatggaggcaaccatatatgggtaagtcatttagtctcttaggtaggcgaactgaggccaatctccccacttttagggctgtgaaactgttctgtatgatacaataatggtggatatgcgtcactatacattcgtccaaatccacagaatgtacaacaccaagagtgaaccctactgtaaactatggactctgagtgacaatgatgcatcaaataggttcatcagttgtaataaatgcactgctctggtgcagaatgttgatgatggaggagacaggggtacatgggaatctccgtaccttccattcaattttgctaaaactactctaaaaaataaaattaaagaaaaaaaaaaagctcccctctttccccagttttacgatttatttatgctttgtgaaatggagtctcactcttgactcccaggctggagtgcagtgatctcagctcaatgcaacctccacctcccgggttcaagagattctcctgcttcagcctcctgagaggctgggattacaggcgcatggcaccatgcccggctaatttttgtatttttagtagagatggggtttcactatgttggccaggccagtctcgagctcctgaactcaagtgatctaccgtacccggcccccaatgttagtttttaaataaacgactatgtttaattcacatgctaacaggcacctagagaatactttcaagtaaaaagattaatgaacccacttcgcattgagttagctggttgttttctgccaaccaggtgtccctgcctggtccacagttgaccaaggatccctgcatctgcctctagcaacacccaacactgtatgaagggctgagggggtctgacagttcacgtcactgacatcctctcactggtatttcgaatgccaagccagccctcaaatcaagttcactggcctcgactgagctgccaagtatttcatacatggggaggggggttggggggggggagggtatggggatcacacaggtgccaggcaatgagtaagattatcccagcaacttctccatgcagagagaaatgtctgcagctgcaacactatttctactccagccttctagactccatgtagtttgcctttgtttgaatgtttctatttatctgaaataaccagaaatcatttttattattatatattactccagtttattaaataaatgaaacaaggcttatgccacatattccaacaatgtttaaataaagagcttgaaatataaaggcttatgaaaacttcatactctttatataatgcatactatttctagcacatgaataaatataaaggacaggagccactttttatattatgaatccacaacattaagcatcaatgattacacaaatccataagcacacaaacaaaaaaacccattggttataaaaactagaattccttttggcatatttaagaaaacccaaaggtggggaggtacttatagccagaaccctgacaacgaggggaccaagtctcccaattccttaagttgtttcttggttagaagcttcaacaattgcattaactctttcaaaaaaacagaaaaagcaggttaagatcctgttcaataaggcacttaataagtctacactgaagaaatactatgcttttatcttaaatcgtgcttaagttttaccatgaggtttgaatttctttccaccttggtaggaacatgtatgtaatttgaataaactggtaataatacaaaaa

SEQ ID NO: 97 - DNA, 1790 bp, Homo sapiens
  nbla22161
gttgactacccttcttacaacaaaactgtttcttttttattgcaaatagggctcttggtgttttttacttttttgtacatatcacagtacatggtttttcactctttagtttatttcattttattggaattaacttttttttattctaatactgacagagtttgtaatctctatataatacgtaattactccaattacagcacttttaccttgaagagcatctcagtttttcccacaatttcattgagtcatcagagactgatgttgcttcttggtttcaaatttggtcctaaagaaactttcggctgtagaaacaaaagcacagagtgaattttttacaaaagacagggaatatagaatagtcattacagacacaaataaccctagtagcacgaagttggtgttttctctgtttttacttaagattaagaagatttttggtgactctgaactctttatttatatttcagtttaaaatatcaagactaaggggcatcagttatctttactctttaatattgcccatattttaataaattacactaattaaacgcatattttcagcataccagtggaattaattttgtggatcacacacatttaaatagtcatattgtgggaatattatagctggtaaccagctgatattgattcttattataggaatgactgtaatgatagtggtggtagcagtagtgatattagcggtggtggtgatgtgaagtaaaataaaagtatatattatattgtgcccaatttattagaaattatttgatcaatgcttcatttcattaaaatatcataaagatgtttatagtatttttttactttattatttaaatcataactaacaatatttttaaaaacttattttcattgctacaatgtcaaatattccaaaatcagccaactacagctatatatgtgttatgtgtgacagaagtgatcttccttccctctttttgagcttgacatgaaagtgaaagaagactcaatgaataattatgagctatttatttaataattacttgccttgggtgtaatacagtaatgaatgagtgaaacaaatattctcattgaatatgatacaatgctgttttctgtatgtttcatgttctattattaaaggtatccattaggccaaaattatttaatcaaattctttatctgataggtagattgagagcattttcttaatgcattaccttgtacataagtatacacttggtaaagtagacgaagttgaaatattaatttcatttggcatttagcatgtgaatatgattattgtttgattgtgtctgtatatttgtttggtgacgtgctcaggtgctcccactactgattaatgtgtgtgctaatatcctaaaaacacatatgaggtttaagaaaaaattttcttgtctgaaaacataaacatcttaataaaactgattttgaaataaaaactaaagtacttgaagatatgtcttgtttctaactatatgttgcatgccatgttggtgatttgctaatgtgtttttttgtttgtttgttttacccaaatccctttggaaaatctaatggacaaatgcaaattcttggactaaggactgtataaattgacctgaaaatacatgagagttgcatttaaaaaaaaatgcttgtaaatccgtcttgagttttactctatgtaaaatatgtcttggttttgtgattgtatacaagatgtatcttgataacttatgtaaactgtgccgtataaaggctgttgcctcagccttactaataaatactgaaaatatcaaaaa

SEQ ID NO: 98 - DNA, 1955 bp, Homo sapiens
  nbla22252
aatgcaaccggtgagagtggggaggctaagctgtcgattagtcccggcacgtggatgagaaagacaacgaggagggagcagctagaggggtggaaatgggatcacgtgaccttgcgagaagcagggagagagaacactgcgtctgctcccttttagaacagctcaatatagggaatccctaacagaggacttccaggatatcctagggacagcagagcctcaagatccagggaggatcctggatacctgagtcaccacttggaggggaatctcctggaagaactgattgatcagcaacatctacattcaacttgagggtcttcttgcttggtgagcctggtggttggccaacagctctggcattgtgggacccacaccagccaggttagcctcccatccgctggacatcatgggagtactgagcatcagttcctccttagtcttgcaacaggatggaacggttcccagggcgctggcacttccattggcagcagcagaagaaccaaaataggacacaccaaatggatctaattttgcctgaacctcggtctgcaaggatcatgatttgccatctgggcacaagcttagggaagctctgggaacagctctactcccagaaagctgggtgaaaatcaactagacccagcagggaagtctccgcgttgatcagtggggccttgctgggctgccctcccagtccccacaggtgttccaaggaggggcctgaacaccaggctctggaaaacctgaggatgatgttgctggagttggtgccggggctcgctctaggacaggcgtgggctcctcctctccactggtgtgcctttgggaagggtatcctccacccactgtgcacccacccgacctgtggcttggagcaggccctccctggccagcagctctgcttctgctgagtgaagaggaaggagcacttggctctccctccaggaggtgcatgaagattaattagaaacttacaaatccacagaaagtttgaagaagaaagtgaaaaaacttcctacccccatcacctcaagatattcactgtgggtgtgttggtggactcctgatggacaccccagcttctcaatacctgggagtgcaggcacaaaccttgaccactctgtaatgccactatcatgctcagttgtcctgctgtagctgaaatcatttctgcagcaacctcttggaattaccttgaagaagcagcccagacagatcctctgaacattctctaagaatatagcggtgaatgtggtgtttccctgagttctgtgagctgctctagcagattaatcgaaccctagaagaggattgtgggaagccaagtttacagccagcagaaaaatgaaaccatcaatgccagcgacagggtgctgaccaggcggaggcagcacgggggagcacagaggctgggtgtttacttagcttcctccctctgtactctctccacccggcccctcagcccaccgctcttctcttcctggggcagttccctctgctgagcgggctggatggagattttccaagcaggaagaggagtagagcctcggtagattaagttcagctgtctccttcattgtactggctcagggctggccgggatcctctctgctaggggcttgaggtggaggcaggacggctcaggaggacccactgaggatcattctgcagtctctgcaggtgctggtcaggttctcagcgctcaggctgcaggtagctgggcttccacaagggggcaggtgctctgcggggtgcacccctggatcacccgtgccctggcaataattcatgctcctgagatacctttccaatcggtatcttccagccttcccctgctcccaggctccgtgtgggcaggagctgagtcttcttcaacttgattctctctgcatctagtccagtgcttggaacaacataagcaggaaataaatattggatgaatgaatgaaaaa

SEQ ID NO: 99 - DNA, 2059 bp, Homo sapiens
  nbla22347
gatttccaggcatcttaattcttcttttgctgtgctttcaaatgggttattttgtgggtctcaaatatatttccttaaatatttggtgaatccttggagttagaagagaaaggaatattaccatcattttattagtgctggtcaattctgatgggggtaaaaattaaagaagctgatatggtaaagacgaagaaaaaataaaaatatggggagactgaccctggctttcattggcgtagttcatttctgcccttcctttctatagatttaaataaagacaagtatttattttgactaaatcacagacatataaggcattttcgggggtagattgcagaggtagtaaaataaactatagtatttcttggatttgcttatttcttgtagcagtgtctatattaatgcatcttgaattttatgcagtgtaattactgtttagtgaaatttaaaaaaggttttttaagagacatggtcttactctgtcactcaagctgttgtgcagtggcactatcatggctcactcactgcagctggggactcctgggctcaagtgatcctcccacctcagcctcctgagtggctgggactgcaggcatgtgccacctcacctggctaattttaaaatttttgtagagatggggtctcactgtgttgttcaggctggtcttgaactcctgtgctcaagagattctcccactttggcctcccaaagtgctgggattacaggtgtgagccaccacgtccagccttaatgaataatttttttaaattgaaaagtcacaaaacttattacgaacaaggtaaaaggtgtacagtttgacttagctctttgctcaaaaatactgataacataataagtagggtaagcctccccagtgcctcaaaataccagataccgtgttcatcattctctcagacatgagtgattaaagtaagattatttcatttttttatgatacctgctgtgctcttgaagaagactgtcttattttcacttactagtaaaagtgaaagaggaacattgttttaacattttaaaaataaaaattattttttaattattgttgatttgaaataatcagtttcctaatatgttggttcaggtttcctgagatgcaaggaaataataattgtaccagaatggggggaaaaggagggaagaaaaaggggaagagaggagaaaccagttgcaatgaattatagtccttatcatgttactttctgagaaataaaatgggcttctgattctaaaaaatatactgtatctgcaagagtaaaagtcgtaatctttcccatatttcctataggcaaattaagttactttagtggcaaagtacatttaaaggcccatttatttcttcaatcacatgatagtaaaagttttgtcaggaggtctgctgaactgagaatacagaatcagtggcagtgacagaacatctaaaaatttccagtcaccatctcctttagacatactggtccttgcattagtccttaagccaacataaatgatctttaatgtaaaattgtaacaagtacataaagcaggctaacgtagatattgcgtatctcaaagcagttggatttaaaataagtgatagttaacgaaatccaatactgtaatgaacttttgagaaaaaaatagttgattatgctttttaattgtgtgtttggggttttggcttttattattactgttaatttggccataagctcattatgttaatcagttttaacagtgtttctccatttgctggataagaatttggctgattggccgggtgcggtgttgcatgcctgtaatcccagcactttgggagactgaggcgggtggatcagttcagctcaggagtttgagaccagtctgggcagcatgatgagaccccatctctacaaaaaatagaaaaattagccagtgtgttggcacatgcctgttgtcccagctacttgggagtcttgaggtgagaggatcacttgagcctgggaagcagagattgcagtgagccgagatcatgctactgcactccagcctgggcaacagagtgagagcctgtctcaaaaa

SEQ ID NO: 100 - DNA, 1773 bp, Homo sapiens
  nbla22352
gtaaatagtagaatgtgaatctggttttcttttgcttgcaaattgccattctttttttttttcaaatttaaaattacacatgctgtttttttctttgatggggagaaagaactcattccctgagttcattcatttttgttgatgtcatcggtaatcttcaagacttattgaagtagagttgtatttggggaagatacattttatattcacttttttttttctttctgtagtctacctcttttactcaaactgtataaggaaatagtgactgattgttcaggtttggcattttcattgctacctgcctgcagaattaatgccctcttccttgtctaagatattactgtgttaagtgtcctgttaattataaatagttcaaaatggacagactgtcaacttgaaatttacttatgtaaaaagcttaggtgattcttagggtttccatgttcataactttacaaagctttataaaaataaaattgcaacttaatagagctaattaacttgtatttgtataaaaagaaaaaagaattgcagctcgatattgtgaagtttttcaataacttcattaaaccatatttatgatgggagggaccagacattctatagtaataatgtatagtgctgtgtataattccatggtttcttcaacatcttatcaaccaagtaaaattaatacaagatacgcaaaagatagtaaaataagaatctaattataggtgcaaggggactcaggcttatgctggaagaatctgacaagtggtatagtttgtttttctaggaagaatttactgatgagtcacataacttgcatgtaatattaggttctcattttttagcttcgaaactgtgtccatgcaaagactctataactgttaagacttgtgtggttgaattttgacttctttgatattcagcatttagtgcatacattttgcaactagggaatttgattttctatacccacaataatatttatggctaacatttattaggcacttactatgtgctaggcactgtaagcactttacatgcataatctcggtattccctgtgagtacagggttaattatttacctctatttcacaaatgagataatgaagtgggatgaagtgcgaggttaagcaacttgcttgaagtcataggtagtaaatcgtggggccaattttaacccagacagaccactgactccagttcatgcttttgctgcctcacttttttaagtggtatttttaattaggaagaccatgctaaagatactttcaaggataaatgattattttctcacttcaattgttggtttaaaattagcataaataggtaaaaccagcatgctcaaacactgagctcaaacattaacattactaataaaaaaaaaaaagagtgactttaaaagtttctttctatccagggtttctcttgggatactcatatggtatattactggcttatatttcaaaattattttattcaacatgattgactttggccttttataatttacataaaacataattttcctcagttctgtaatccagattttccccattgagtaaataatacaattaaatttacatatggtaatttagacatttaataggatattgcataggtagaatactttgtcagtacttagttactacctatatgtatttttgtgttacttttcagtgatttaaagaaatctaacagaaatctgcttaaatttgttttaaatagtgaatatcctgcttgctatggaatgaataaacaggtaaatttgatatgaaaaa

SEQ ID NO: 101 - DNA, 1641 bp, Homo sapiens
  nbla22394
aaaaaaaaatgattagttaagtgcatacattatgaaacttacagaataaaacttattatacatctctttcttaaattaatatctttacacattttcaactggctccccaagtctgataaggaaggattaaaagaaaaaagaaatgtattagttgggtggccaaggagtttcctttgtaatgttgagagacttccgctttctgaatttcgctggttctctaaggtaaaagagttaaatagtacccttgttcaccaaggaaagtgatccaaactatatatctagtgcagatatttcctttgcattatttagtcttctctggagagaaaatacagtttccccttcctctttctcttcacatttactcttttcaacccaaaataagagacatagaaagcaaaccacagccagtttggcatcttctcagtgctactagtataggcacatacacatacacagtctcagcaaggttataaagaaccctgtcaggtccacttgcaacatggccttgctacttggattagctcctttaagcctgaaaataactttcctggtcatggaagaactggacgcatcttttaacttatgaaatagaagttgaacttgaaaactctttttaaaaaatcctggttttgcaggacagctacataatgaatgtatatattaagactgtagctgaattgcacatgaaatcagattgccaacttcttgactttcaatgttagacatttatccttaagttgtgagcgatatatgtagcatgctgtgaaatgtctgttatagctctttaattcatcagtattaatacagaattatcatttgcgtttcttggtactttttattcaatgtaatcagaagctgtgatgttttgcctttgtagtcctgtgctttgttactgtaatttttttttttttttacgaagcacgtgactggactaatgtaaggcagatgacgtgatctttaagactgctatatatatcagtctcttactctataaggttttaaattagaataagcttttatcaaatagataattgatgcaatttaggattcacgcaagtttcagtgtcaaatggcggtcttatagtttcaattctgaaaatagcaaacttaataaacagccactttaaacttgttctggcaaaccagaccctgctgtagatatagtctaaggtagttaaccatataagccttttcaactcttaatgccctccacatgaatcagcagttaagaaggttctagaacccatgaaagcttttgtatgtattactaggttttgtttttcttatgtttgctgattttacagttctgactaaagctgacctaaatggatcagtttatgtgtaatattctagtgctttaatgactctttttttctttggagggagggtaacattatttggacagatgcagaaggaactgttagtgagtcaagacaaacacatctgaaataaaggaactgtgtattaacatgttaacaattcataactgcactttttatgacattttgaaaatctatttataggtacagaacaatgggttttgttaaactgtatcacatttatacttgcagaaatttatttcattgttattagtaggaattttattggttcaataaaattggcaaaactgaacaccaaaaa

SEQ ID NO: 102 - DNA, 2960 bp, Homo sapiens
  nbla22423
ttggggcatatcgctgcatcagagaatccacagagcaatgcaaatagagaaaaaacaaagttagaagaaggaaatatgccaaccacttgactagagaggaaaaagaaaatttattcagggaagaaagccacagaagtgtccctttgtgcttttctagttcctttaggagattttgtctctcacacattcatcatgtttgggccaagcccactgggtgcagcggtgcagctcgggaagcatcggggtgagcttcaaggacagagtttcttccagtcctaagttgtctgatatgtttgttcataaaactgccctttctctgacttttcaggccacgacccccagccagaaattatcgttttccccactctttatattataatgacaataagatttttcagtgggggagcatcacatatgcaatcaggtggcagaaaaagttcctgcaatatgaatttagagatttgattacccagcacatgtttctgtcctgtctctaacagtctctggaatctggtagaccttcctgaatattttgctttgtctgatgatgactttaacatattgctgctggtgtgcatccgtgtgtatactggacagcaggaaactagcctgtgccactgcccagctcagcagcagaacaagaggtctttgatgaccgtaagtttaagaaatataaatatgttctgcaccacagaatatacagaacaagattcatcctagctagaaatatatcataatcttgaatgtgctttttaaagccactgcaccaagccataaacctcttctttttaagtttattgggtagtcagtttctagcttcggtcactgctaaggaagacaaaggaggatactgtcagattcttcctgctcaaaatgttctccatcctggcagtatatcagagcaggtcaacaactcaacagcttgcatctcagaactactgggcttttctaggtgccctgctctctcccctcccccgtcctttgttcttcaaggtctttccatgcctaccacctgaggttggagccctcgggcattttttagttctgccaaagcacatagtcattgaaagacctgcgtgatccccgtaactggcaagccacaacctcttctctcaaatgacctccttctgaaagttttcagaggaaagaggattgaacagagagggacagatgatcacagatatcttgaaattgccaaagggagtagacttgttatgaaatgctgtgagccagacacgaagggaaaaaaccaggacagctcatttgggcagagagcaaagacaaagccttcaatcctattcaggagctgagccctgcaggaaacccactgcctctagccacagtggagaggtgcaggcacagtgtggttggctactcatcggaggtgatgcgggggttgtctgagaatggagggtaggaatgatctttatctgagtcccttctacctgagaacagaacagaacacacacgcacacacacacacttttgtataaaaagatagataggaatttaattttcataatgaaacatatcaaatcttttgatatgttcactattattgcttagtggtgcacctttaaatacattcattttaattaaaaagtggatcaagttaagcaaactaaatggtagagtttatacaaacagagttgcaatgcaaggactaaggttcttagatctacagagtctctcatacttggaagtgaagctatagatgttttttgaggtggaatctcgctctgtcgcccaggctggagcacagtagcacgatctcagctcacttgcaacctccgcttccagggttcaagggactcttcaacctcagcctcctgagtaactgggattacaggcactcgccaccatgcccagctaatccatgtattttagtagagatggggtttcgccatgttggccaggctggtctcaaactcctgacttcaagagatccacctgccttggcctcccaaagtgctgggattacaggtgtgacccaccatgactgacccctgaagctataggttttatgaggctagaagttgaccaaggagtggaaaacaagcattgcttaactgaaccaagacatctgttggttgaccttctcagaaagagaccaaaaagtatagcatttgatcaaaagataactattaatattacaaatgaaaagagggagagaaagaaattataatgaactgttaaaaagaattgacaaacggatagaaactggaataacatagtgaggtgtgacaatggtaagagcagagagaaagagtgagaggatatagagtataatgttaaccttgttcctttttattaagaacatcctaagcgtcctaacattagacgcaaccatgagggccgcctagcaaatatgtcttgagattccagtgcatttttataccattcctaaattctgtataacaagtttctggttaacaccatggctaaacacaattatttctgaattcctgtcactctgccacccatatgttttaaaacaaagaggtatcctcatttcactgatgtttaaactcaggaatgagatgtgtcagtagctttgggaacatgtaaagctggaaagtaggaattctttaaataaaaactcctagtctttcttcctgagaccttgctttcagtgtgaggtggctgaggattggcatttgacttgccgtccccagtcaccatagtggagacctcagtccaccaagaaatcaggcgaatgctgtgtttgcaatgggagagacaagatgttgagtgttttacctgtattacgtcatctctcctcaccacagcccttgaaacaaggaatcttacctctatttttctgttgttccagaagagaaacttttttgggagacatagcctccctgtatcacccagaaggcagaggttagagtgagccgagatcatgtcactgcactccagccgaggtgacagagcaagactctgtctcaaaagaaaaa

SEQ ID NO: 103 - DNA, 2920 bp, Homo sapiens
  nbla22439
cttgactcctccttttaggatgtccagatgtaaaaaaaaaaaaaaaaaaagaaaaaaagaaaaaaaaaaagaaaacagctgcagttcagtacaactgctcttttcacactcaactccctaaaactccttgtaaccttctgtaactattggatgacgctttctccagcttagccctaaataaagcacagtttaaaaaaaaaaaaaaaaaaaaaaaaaaaaaaaaaaaaaaaaaaaaaaaaaaaaaaagagaagaggagaaagagagagagcagagagcgagcggagagcgaggtgtagagaaaccgagggggagagaacccgagtgtgtgtatgcgtgtgcgtgtgtgagcgcgagcgagcgagcgagagagaggagcgagagagtgtgagcgagaaagaataaaaggaaagaagattttctctatgtatataaagatggccacgttagcaaacggacaggctgacaacgcaagcctcagtaccaacgggctcggcagcagcccgggcagtgccgggcacatgaacggattaagccacagcccggggaacccgtcgaccattcccatgaaggaccacgatgccatcaagctgttcattgggcagatcccccgcaacctggatgagaaggacctcaagcccctcttcgaggagtttggcaaaatctacgagcttacggttctgaaggacaggttcacaggcatgcacaaaggctgcgccttcctcacctactgcgagcgtgagtcagcgctgaaggcccagagcgcgctgcacgagcagaagactctgcccgggatgaaccggccgatccaggtgaagcctgcggacagcgagagccgaggagatagaaaactcttcgtgggcatgctcaacaagcaacagtccgaggacgacgtgcgccgccttttcgaggcctttgggaacatcgaggagtgcaccatcctgcgcgggcccgacggcaacagcaaggggtgcgcctttgtgaagtactcctcccacgccgaggcgcaggccgccatcaacgcgctacacggcagccagaccatgccgggagcctcgtccagtctggtggtcaagttcgccgacaccgacaaggagcgcacgatgcggcgaatgcagcagatggctggccagatgggcatgttcaaccccatggccatccctttcggggcctacggcgcctacgctcaggcactgatgcagcagcaagcggccctgatggcatcagtcgcgcagggcggctacctgaaccccatggctgccttcgctgccgcccagatgcagcagatggcggccctcaacatgaatggcctggcggccgcacctatgaccccaacctcaggtggcagcacccctccgggcatcactgcaccagccgtgcctagcatcccatcccccattggggtgaatggcttcaccggcctccccccacaggccaatgggcaacctgctgcggaagctgtgttcgccaatggcatccacccctacccagcacagagccccaccgccgcggaccccctgcagcaggcctacgccggagtgcagcagtatgcaggtcctgcctaccctgctgcctatggtcagataagccaggcctttcctcagccgcctccaatgatcccccagcagcagagagaagggcccgagggctgtaacctgttcatctaccatctgccccaggagtttggggacgctgagctgatgcagatgttcctccctttcggcttcgtgagcttcgacaacccggccagcgcgcagaccgccatccaggccatgaacggcttccagatcggcatgaagaggctcaaggtgcagctgaagcggcccaaagacgccaatcgcccgtactgagcgccggcgggagcgtcccccgggggagaccaggactcgcacagggcaggatgctgaacgggctacattaaaaaacaaacctctctctatatatatttataaatgagaactgttggatgacacctttgacatatcagccaatatcaatcaagctgaagactccagacactgtctgtgtgactgtaacatttcttcaaggaaagtatagcgtctatggagttcagagggcacgtgtttgggggaaaatatatatgacatgaagaagaagatgaagaaaaatgagaaaaaaacacacaaaaggcaactttaaaacaaaatatcacgagcagacggggaggctgaagggctgggagctgggaggagacgctgcttaccgatcccggggcttttccagcccacgggcgcctgacgcaggctggggcaagtggtgcgtggggcctggtccccaaggggcggctgagaggccgccactgagcatctctatctgtcattcctttagctatttagggaccaaaggaccaaactttttattgcagatgtgtagctctatgtcaaatagagggggaatggaggaccccctccttcctgcctcatggctgttcttgaaacagcttagagcgattctatgaaaaaatgtaataaaaaattaaaaaaaaaacaaaaaacaaaaaaacaacaaaaaaaaggaaaaataacgcttcaatgcttttaaaacagcaagataatagttctttgatactttgagaggcgctttgatgaccctcatccaagtctatgacactttcctatggttttctgtattctatgtctggatggagctgttaaaagatgaacaaattggtggatatttggggaaagcaacacaaatcttaaaactcacccgtgaagtgtgagaaaacaaggaggggaacaaatgggacttaccaagcaaggtcattgttgtgaaaagtctgtaaatgcttctaactcttccccctcttaaaatcataatagttgtacagaattttaaaaaggaaaagtttaaaatacctatataatagaagaaaaattagaggaaagcaaaaaataaaaa

SEQ ID NO: 104 - DNA, 1522 bp, Homo sapiens
  nbla22633
tcaaggctctcccaggagtccccctctgccggccccccaatgccccagctccctcctactcgctggagatccagtggtggtatgtacggagccaccgggactggaccgacaagcaggcgtgggcctcgaaccagctaaaagcatctcagcaggaagacgcagggaaggaggcaaccaaaataagtgtggtcaaggtggtgggcagcaacatctcccacaagctgcgcctgtcccgggtgaagcccacggacgaaggcacctacgagtgccgcgtcatcgacttcagcgacggcaaggcccggcaccacaaggtcaaggcctacctgcgggtgcagccaggggagaactccgtcctgcatctgcccgaagcccctcccgccgcgcccgccccgccgccccccaagccaggcaaggagctgaggaagcgctcggtggaccaggaggcctgcagcctctagactgatgcccctgcccccgcccatccgcccccacgctgtacagagtgcatgaggagccgccggaccaccggggaccgactgcctgcgtccagccgcgccccatccccgaggccgcctgtggccaccatgtcggccctctttccaccaccccttgctcagcatgtaagccccacccacccctgccctttcagacccctgcggtgacctggctcggagaaggtggccctgggcaccaaggggccaaccgccctgaacactggggcagggaccatgctggggcccggggccacccccttcctgtcaccagcttctgtggagtccagtgttttgctttgcttgcttgtcccccatcctgtcctgagccggggccccccagcctcgcctccctcctcctaccatccctcacttggacctgggggtgtggacagtgacccctccctgaatatggacttgaatcttctgagcagaactagggcctctcccctggtgaagacccagggaacccaggagggcccttctggggcagtggctctgcagggtcactcatggaggcctaggggaacagcgagatgccccaccacctcctggcgagtccttcctgttcagctccctgtgcgaccctccagggatgcaggggatccaggattctctgccctgtcacacggcgagtcagaagggaggggcctttccctcggacccatggccccaggcagagttttgcaccagcaggacccctttgagggccttcaaggctctcccaggagtccctcttgggtcctgtgccaagtccgccccagggcctggggctgttgggagccaagggccccctggtactcagttccctcacgattcccgatcacgggcacacctgccccctggttatttgtaaatatttctattggacccaattctcctcggaattggctggcacctctggctgccgcagctcagtgatgacgtgggggaggtgggagaggccgagggctttgcctaggggtgggttgccctgtatacatgatccagtctgtgactaccagccaacctgaataaagcggttttaaaaa

SEQ ID NO: 105 - DNA, 2914 bp, Homo sapiens
  nbla22698
gttttaagaaactgactgtggctccagagtatgttggagaagtgaaaatggagactaggaataacaggtgggagactattagtctaattaagatgtaattataaatctaagctaggaacgtaaaatgagaatgcaaagtaagaaacaaatatggggaaaattatatgtaaaagtaataggacttggcatcttactgatgtgattgattatgagaaaaatgaagcatgtggaggagtccactggacagtaggaaattcagcctaagacttgggtaagagttctgtggagttgtgaattcagaggccagagatgtgatatttaaaattttggttcaagatttcccaggtataagaaagcaagaggattaaagcattgtaattaaactttaagcagtgcatatttatgttatagataagataaacaagaaatctagggatcaaataggattaaaattagtagtgatcattcagtacagtagttacgtactgttattcacaagagtatataaatcaaattacaaggaattaaggatataaacgtgataagaaagtatgcactgtactctttgaggaagtttgccatagaaaggaagaagaaataggatggtagatcagaagtaaagcaggacccagtggggggagtgtttgcagtgaggcagtatgtataatcatttaaaacatgggtttggagtcctctcaggttccatgtttgtaatggacataatgataataatccctttcatttaaggctgttgtgaggattaaatgtgttaatgtgcaaataactttacacagtgcctggtatataataaatgcttgctacctattaactagtatttgtttctaaggctaatttaagtcctagaattgattgcaaggattagatcaggagtatagtggacatgttgggatttaaatatttaaatatagagatgctttttaggaccattgttagaaccagaagagattttttaccaagttcacacagaaatgtaggtgcattggctgggcatggtggctcacacctgcaatcccagcacttgggaaggctgaggcagaagaactgcttgaggccaacattttgagaccagcctgggcaacatattaagaccccgtctccaccaaaaaaaaaaaaaaaaagaagtaggtgcagagctggaagcagaaccgaaatcatcagtgttacagtcattattctttcctgtcaccattatatgtctttatgaagcaagggagaaagaagaacagatgaaagaagtgaggattttgaagttggttgaaagatttgattgaattctgatctaaaaattataaggcacttgtttaacaagttgaaagtaggaaagtagacataagactctactagatttggggaaactctcaaaaatggactggaaattcagctaaaagtggataacaaaatatttctagaattagcatttgtggggtgtgtgtgttttcactctagtatttgtcaagcccagatgaaagcatagacagaatgtaagactggatttatctaagtctggaattgtgtaacattaaaggaatagtagcaaatgagcagagtgttggctcaagcctaagcttgagcctaagcttgactctatggtaaagtcaagtcaagggagaatagaaagggggtcaccataaaggtcaaaagtgggtttagtggttgtgtgggaataggcagatcaagaaaagaatgaagttaggaaaggagatataagtgttgaatgaccattacaaaaagagacagaggaaagaaaaatgaagatgtatcaaaagaagttgctaatatggatggcaaagtagatgtttttaagaaatcatgagaccagagtcttggaaaagtcataggatgatgcagggaatggagaagagggaaataaagccaggtgctgaagtctttatgtaatgggaggagatgttccagtaatccaatggctattttgatgggaaagagtgtggtatgattgggtggcattgacatcggaagccatcctcattgatggtggtggaacagcagtttgaaagtaacattgtgcggtgaggtagagtggcacatgatgcatccttattcttacctttggagaaaagttgagggagaccaaaaatgactttttgagggaattgtagaagtttcattagaagaaaagtaagtttttaattaaaaagttaatctgaggaacaggtagaataaaagtgtagttgttagtggtagaagagaatggattccatagggcaaaataagaactcaagggaaggttggtggaagaggaagaggattgaattgtttcaagaaagaatagcagttgtcatccttatgaaaagtaaaatttttattttcaaatcaggaaatgtaaaatgtgccttccagaccccttggtggtatacatgggagattggttctaggacacacacagtcccatcccccaccctctgaccccatacaccccctggatactcaaatccactgatgctcaagttccttgcataaaatggtatagtgtttgcatgtgacctatacacaacctcttatgtgtactttaaatcatctctagattacttatattacccagtacaatataaatgttatgtaaatggttgttatagtgtattgtttagggaataatgacaagaacaactttctatacatttgcagtacaccattgttttacccccaaatatttttgatccaaggttggttgaatcggaacccagagatacagagggctgactatactttaagaattagaattagctgggtgtggtggtgggtgcctgtagtcccagctactcgggaggctgacgcaggagaaaggcgtgaacccgggaggtggagcttgcagtgagccgagatcgtgccactgcactccagcctgggcgacagagcgagactctgtctctaaaaa

SEQ ID NO: 106 - DNA, 1696 bp, Homo sapiens
  nbla22896
catgtagcaaatctgagaattgaaaactgcagataaccggccgggtatggtgactcatgcctgtaatcctagcactttgggaggccgaggtgggtggaccacctgaggttaggacttcaagaccagcctggccaacatggtgaaaccccatctgtactaaaaatacaaaaatttgcctggtgtggtggtgcatgcctctagtcctagctactcgggaggctgaggcacgagaatcacttgaacctgggaggcggaggttgcagtgagtcgagataacactactgcattccagcctgggtgacagagtgagactccacctcaaaaaaaaaaaaaaaaaaaaaaacagaaagaaagaaaaagaaaactgcagataaccctatacattaatactggtatctcgaggtgactcttctgaccaagggtggttaagtgacacatagaacttttctaagagaagacagacaagttgacaggcatgccttgtactcagctgtgttcatgtggtggtctgtggaaagaaaagaagactcatttggaaatgaagctgtccctttccaagcagtctctggtgcttttcttctctcaaaatggatccgataaatatttgaatagagcagattgtagaatgtcgtgctgtcaccagaaagctgctgttttgggttctgcattgagccaaatatgtagaggacctaccaagcccactgagggactaggttttcatgtctctagtcatacctagaatgttctgagccgtctgagggccttcatgccggcagcagctagcaaagccagaaagcaagtctaacaggatctaagatgaccatcaggagaaggagtttgagactgtgtatgcaacccccaatagacccccttttactctgatctggagaatgtatctggcttcatattttcaagtcacatgtctctcagacccctggattcagaacccaaggccacaaatcataggcatgaagcactttcttaagactgacctaacgctggattatttcccgtccaatgcctgcatgctgcttgaattgctccacccacacctccatgaccaagggcgccagagtgctgcaactggggcgtgggccgctctctgcttttcctgtctgactctgacaagtcctccctcactgaatgtagaatcgttgccaagtttctgagaagtgtcgattccctgttaacatggatatcagttctgcctcacatttcccacttgaggttgaggcgtactggagacaacacctcagaccatctgaaccccatcagtggatgaaaatggggctgttaatatactctaaaagccatactaaaaatgctctgagggaactggctaagaatagtgggcctggtgattgtctatcacgcaaggctttgttttgtactgttcagaaatctgtcacctttctgcctgcccttgtttcctgaatgaaatgcttctggggttatttatgaaaggagtgatcctggggcaggcaggaggcagtgggcttcatggctccttgaagttattactgatcttgaccttctctttggctacctttagacaaagaatacgccaatcaatacttggggctctaagttttacaattgatatttatttgtatcatctctttgtctaggaatgtaaaagtgattctaaactaagatgtgtaataaaaatcaatcagatttattgtacctacaaaaa

SEQ ID NO: 107 - DNA, 1742 bp, Homo sapiens
  nbla23167
gagcatacacagggaggcttcactgggagaccacattgacccatggggcctggaccacgagtgggacagggctcaacagcctctgaaaatcattccccattctgcaggatccgttcccctggcagcagaaggtcaggtttgccaaaggaatcgcctccggaatggtgagtcccaccaacaaacctgccagcagggcgagagtagggagaggtgtgagaattgtgggcttcactggaaggtagagaccccttcctatgcaacttgtgtgggctgggtcagcagctattcattgagtttgtctgtgtcactgaaactgaccccagccaactgttctcagttcacagccctgttttcaaagaattacacatctctaaaggcaaacagggcacggacaaggcaaactggagaggcaaactgtagcctgagatggcctgggcttgccatcacaggtattcaggtgctgagggcccttagaccaactagagcacctcactgcctaggaaatcaatgaaggggaaatgagttctagcggagccctgaaggatcagaattggataaagttcttattggcagagaggcaccaggattgaagtgacaggagcaaagacctgggaggaaagaggagaaaatcatctatttcacctggaaacaaatgattccaagcatagaaataataacagctgacaagtactgagtgccctctatatgctaggcactgggctgagggattaacatgcatgtgcatgtttattcctcatgacaaccttggtttccagataagctggactggaaagggacagagctgggatcctgggctaatcagtctggtcgccaagcctgagactttagccactgcccttcacatgggggtccatgaaaatagtagtagtctggaacagtttgggggtacatcaaggtcgctgtgttttaagctatggagtctggactataggagacaaatgtaaaagagttttttggttgactggctttttggtttttttgtttgtttgtttgtttgtttttttgtttttttttcctgtttctggggcttgaatcaggaaggaggtttttttgttgttgttgttttgagaaaggatattgctctgttgcccagactggagtgcagtggcacgatcatggctcactacagcttcgacctcctgggctcaagcaatcctcctgccttagcctcccaagtagctggactacaggtgtgtaccaccacacctaattttttgaatttttttttctttttttttttttttttttttggtagagacaggttctcactttgttgcccaggctgatctcaaactcctgggctcaagcattcctcctgcctcgccctcccaaagtgttgggattacagttgtgagccaccatgcccggcaggaaaagatttttaagcaagaaagcttaagagctgtggtttttccaaaatgagtctgggctggcacagtggctcatgcctgtaatcccagcacttttttgggaggccgaggtgagtggatcacttgaggtcaggagtttgagaccagcctggccaactggtgaaaccctgtttctactaaagaaaaaaatgcaaaaattagctgggcgtggtggtgcacgcctgtagtcccagctactcaggaggccgaggcaggagaatagcttgaacctgggaggcagaagttgcagtgagccaagatcacaccactgcattccagcctgggtgacagagtgagacttcatctcaaaaa

SEQ ID NO: 108 - DNA, 1416 bp, Homo sapiens
  nbla23339
tttgctagagttacatggattatatatttcttaaagggaaaaatttgagagtatcatggactaccaccagcattattattacagtagttactcagatttggttaaggaagcccaagcaatgtatagtgaaaggattattatctctctgctaagattcagatattgtttcagaaatctcagctccagtaattccacaacatctaaaaacaaatgtttgtgatcatgtgtaagcatgaaattgttccaagtaagtgaggatattttagttatgtgaaagacagtttcatggaaggtatttgttttataccagtggctgggatggtggaattggggttatttctacaattattcttagacgattactaaactgttaagaaatgccccatatcatttttgtatctaggaaagaaaaaaatcagtttcatactgttgtcatctgtcagaaatgctcattttattttgaattaaatgtggcttttgaagtacctagttaccttgaattcctggtgaccacatgtttttatctggaaaacctggagaaagttatctgtcccatctcccctgcttgttttttttttttttttttggttggagctgctgtttagatgatgcttttactatgcaggagagagtttttgttaaggatatatttgaagattggcttttccatattgtccttcattctttgaccatggcaaagtgtacagtagattttcatgatcattgcatatttcttgtcattgaaatgtatcttttatgtttttaaatgcattcattttacacttgtgagtttatcattgactttaagaggtagaaatgaaaaatgaaaattaaagctaaagcctttttatctattaatgcagatatattagaataagaatattttgggtttgtgtttattttttaatgaatttatgtttacttgatatggaaaattacgctttataggtggaaaagtagcaaataaagattaagtaaaagtaagtgaaaatgatggggaatatagtattggaattttatagctagttaaaacaataagtatcatctaatttgggtgtttattttgcagatgagaaaacagacctagaaccgtggcatgttttgcctgaaacatacagtgagttagagacagggcctaagatagcttctagcatcagatcaatcccaagaatccatcagcaacctcagaccaacccaagaagataatttaaatctatactgcttattggtcaatatatttggttctagtattaataaagaaaaatgttattaaaatagcatacatagtagtaaaataaaatacaaaaagtgtgttgatttatagctgtttgagatgataaaagtgaagcaaagcctgttaaatcattggaagacttggaaaattattttaaataaacaattacatgtaattaaaaa

SEQ ID NO: 109 - DNA, 1549 bp, Homo sapiens
  nbla23352
gggattgggaggcccacgccctgctgcgagaagggcgcgttctagctcctgaggaaggtgggagtcaatcattttgacaagtctcctgaaaggaacagctagcaggaactgaaacctttttccatttggtctcgtggcaaaggcagagattgctccagcagctccacacaaaatgatgtgctcacgggtgccctctgaacagtcttctggtacctctctcttgcctaaagacggtgccccattttcttgggattccttggatgaggatggattggatgactccttgctggagctgtcagagggagaagaagatgatggtgatgtaaattacacagaggaagagattgatgcactgttgaaggaagatgacccatcatatgagcagtcttctggggaagatgatggtgggcatgttgagaagggagaaagagggagtcaaattctacttgatactccccgagagaaaaattcatcgtacagcctgggaccagtagctgagactcctgacctcttcaaactacctcagctaagtacatcaagtggtcatggaccagctcatactaaaccattaaacagacgctctgtactagaaaagaatcttataaaagtaactgttgcaccatttaatccaacagtttgtgatgctctgcttgataaggacgagactgattcgtccaaagatactgaaaaactctcttcccttggagaagagatgagagaagatggtcttagcccaaatgaaagcaaactttgtactgaatctgaagggatcagccccaataactctgcctggaatgggccccagctctcttcttcaaacaataactttcaacagactgtctctgataaaaatatgcctgacagtgagaaccctacgtctgtattctctcggatctcagaccattcagagactcctaatatggagttatcctgcagaaatggtggttcacacaagtcaagttgtgaaatgagatctctggttgtttccacctcatcaaacaaacaggatgttcttaacaaggattctgggaagatgaaaggccatgagagaagactaggcaaagtcattcctgttctacaaactaagaccaggactaatgttccgacgttttcacagtcaaatctagaacagcagaagcagctttatctcaggagtgtcattgctcatatagaagacccagaggacactaaccaaggtatctcgggggagctttgtgccttgatggatcaagttcatcatatgcagcactcaaaatggcagcatccttcggacctcaccacgcgaaactacgcccgccgacagaaacatctgcaaagatacagtctgactcagtgggttgacaggaacatgcgaagccaccatcggttccagcgtctcccagacttctcgtacagttaatttgtgtcatcccatcagcaatgaaggtccctatccagggtcctgcttggagcagcatttcatgttcttttgctgttttgtgctttgccgattttggattttatttttcacaaaatttttatttaaaaaactcgtcaccttttggaaaaa

SEQ ID NO: 110 - DNA, 1797 bp, Homo sapiens
  nbla23575
gaggatgattaaaataatgtgcatatatgttgaagggcagaggatggtattgcacaatatagatgaaatagtcattggtttgttttacattctatgcatttttaatgagcaaattcccatttacaggaattaaatgttccagatattgatttcagagggacaatatataatatgaaaacaaaattcagtaacattatgtgatgattacatgatgtgtaattcaatatagctagaaccctggaaagtgaataatataaccattcctataaaatatttcagaaaatcaaatttattccctgaagtacattataataaaacggaaacagtgttacttgatttatagtcctctaattcaggcttttaaagctattttcatgtcaaaaataagggattctttctccccttgtccccagtcttgtgcatagtttataatgacaagaaaagctacaaaagaaacattacaaagcagatgtgctcccaagtttgttccagtttaaacttcagctttaagcatcttgtggctatgaaatattcatgtaaattatgtaagtgcatctagtttagatcccagtcactcatgggttttctcacaaagtaaaataccatacttgatcctgtctatttctagagagtgaatgctcacctggtggatttgtaccaaccccttagggcatcagggggacaatcaattaggttcactgggtgttttacctgacagatactctcctaaatactttcaaatgccctctcattttgttctcacaggacctgaagaagtaggtgtcattttcatccacactttgcaggaggaaacaaatgaggctcagtaaggttttagtaacttactggttgtcatacatgaacagccaggtttcaaactcaggaatcaacagggctgccctgactactgggctactctccctacattagatgcctagaaggtatgcaagtggctggagtaggggcaccgacttccatgaatggttaggagtttggtgtatgagcccctgacccatgctgaagtgactcaggaaaagcctagtcctgggaaacttacgttttgtattttttttctctttaacagttggtactgaaggattaaaattatcttaaggttaaaaacaggaatggttgagcattgcaaaaagcttttgctgttagaatagatgacatctgctgcctggctacaagtcattttaagatgacacaaaatgatgctatggagaccacagagcttttgtaagaaagcagaaacgcttggtcacttttccgctaagtgacttccctttattggaagctgtactgaatctggaatgcttataaatggttgcaagggcagatcatttcagagtaagagatatttaaaaacaaagggctaagggaaacctcaattgaaactagagcaatacaaaataaaatctcctactgaaccctaaaagactcctactgactgacccctcaaaagcaccccatatgtctttctcttctcctctgaaaaggtaactcagggcccggcgtggtggctcacacctgtaatcccagcactttgggaggccgaggcgggcggatcacgaggtcaggagatcaagaccttcctggctaacatggtgaaaccccgtctctactaaaaatacaaaaaattagccgggtgtggtatcaggcgcctgtagtcccagctactcgggaggctgaggcaggggaatggcgtgaacccgggaggcggagcttgcaatgagccgagatcgcaccactgcactccagactgggcaaaggagcgaaactcagtctcaacaaaaa

SEQ ID NO: 111 - DNA, 1957 bp, Homo sapiens
  nbla23592
ctaaacacatcgagttgcacacagatggaaataacatttatgttaaattctacaagtgtcctctttgcacttatgaaactcgtcggaaacgtgatgtgatacgacatataactgtggttcataaaaagtcatctcgttatcttgggaaaataacagccagtttagagatcagagctataaaaaagcctattgattttgttctaaataaagtggcaaaaagaggcccttcgagggatgaagcaaaacatagtgattcaaaacatgatggcacttctaactctcctagtaaaaagtatgaagtagctgacgtcggtattgaagtaaaagtcacaaaaaacttttctcttcacagatgcaataaatgtggaaaggcatttgccaaaaagacttaccttgaacatcataagaaaactcataaggcaaatgcttccaattcacctgaaggaaacaaaaccaaaggccgaagtacaagatctaaggctcttgtctgataacttcaagtgatgtacgaaaaggtttggagttcatttttgtggaaagactttaaattggtgttagaaccactaaacatcttcaaatggtactatgaggaaaaaaagaaaaacatttttctaaatattcaactataactgctgttttctgactaaaataaccatctaaccacttgtttctaaggcactgcctattccagcactttcaagtagctgtgatattacatgttgtcatcacagtccatcagctatccacccttgaccttgtgcatttggtcgacagtttctacaaaaatgttacaaattttgttttctaaacaatttgttgattaagtgatcaacaacctgaagaaaatatcaatttttaattgacaaagactttatatcttagtgattttagttttgtttctctttatttggcaacattttcatctgaattgtatagatatatgattttctagtgagtgtatgttaggaacaaaagacaaaatagtatcaacacattataaatatttagcttactaaatatttgtaattatttttacatccatttatttctagcttgttctccagcacttcagtgtttgaaagtttcatcctaaaatatatactacaggaaagctgcagttcattttcatgcatggatcattacatttttcacttgtaaatgtaggtttttatgaaaattaaacattcccctatttttctttaaattttatacaaagcactttaatgatagatgcaaccttatttttcagttcctatttttttaaagaccacacatttactaatgttaatatgaaggtaataaatagcttactgatattttatggatgcagacaatccatgcacaaccacttcttatgatactagtttatttccttaaatattgctacaaaaggaagatgcgggtgtaagccctgatttttttttctcccaagaaaaatcttaaaggaccactttagataatatttgattcctactgtaaaatttagaaaatgatgaattcttgtccatttttgtaatcaagattttaggaaaaacagaagtacatctatctttatgaaattttgggcaggtttttgtgtatcaatattttgtacttttagggaatattttattttttagttatttgtgtcaaattataattataaaaggtacagcagaaaatataccatgtttttatataggttcacacctgtacttaggagggaccctgtccatctatatactttttgtataaaattttaaaatgttaaagatccacaaggtcttaataaaatgattctatagctagaaaaacatttaccttcccagtgctttgcactaaaatatactgtgaaaggaaactagaaagactgtaactattgctggaaatgttctatattgaatgtacatgctcttgttggaaaaatgtactatatgtgatggaaataaaccagaatcgaagttatttcagctaaaaa

SEQ ID NO: 112 - DNA, 1674 bp, Homo sapiens
  nbla23601
gagattacttcctgctgcactcctgtcttgccatgcacgtcttgccccctcacttttgctcagcctagcagtctacttcactttattgccgtgtaagtgtcaggcctcctgggtgctctggaaaagacagggagccaggccctctcacccctactggtaacaggtcattgctgggtgcacaagagggaggtgatttgcatcatggtcatgctgcatgggcttcactgggatgctgttaaacaccagaggagccaacctatcagaatcccagcagcaaaggaaaactcagattttagaggctttttacaataaagtagcgtaactctaggtcatgattgatttcaaatgcctgccatgaatgatttgtaagtatttatgtaggatccatcaaagcagtattgtaggcttttgaattgtcccagtggatccgggaccccatttcactgtctctcttgatcgtgttaatgatgcaatcagagttcaagacaggccccatgaagtctgactgcactgggatggagaaatgaatttcttcccactgaaggaaactctttctcattcgcagccaagacgggagtgccactgttcctctcttcactcctgagatactgcttctggaagcgggtgtcacttcctctctagtacctcttctcttctctgaagtgtgtgactatctcctagtgtttaaatttggcagttactcgccatgtatgtcagcatagaaaaggaaatgtttttaccttatctcctgtatgtatgatagaacttaaaagaaatgtgcatttgttttcatagccccagcagagaaaatcctcttcatagattaaatgtgctgctgtggacaggagggaaaaaaaaaaccctctacatattgaaaggcaccaaatgtaatatctgacactgttaagatgcccaaaagagcaaagttgtagtggagatgcagggtcatttccccatgccatccacagtgtttgttagtgagtccacggctgacttgcagtgataaagaaaagcatggagctgtgtctgcagacaatggtggctgcatctgtaagtggcttcagaggcagcagccctggggaaattgatgggtgtggcagtggacctgtgaagagggagaatctagccttcagcctgtccagtgttaaccactagagaaactgagctttatatccttttttaatgcctgtgaattttagcatattgaaacattagagcaaatactcaggggatttttcattaaacatccctcagataatttaggtatatatcattagaaagggaaagctatcatttttattttaaaactaaacaaggccatcttataaactgtcaccaaagtcttcccttttttattgcatgtgtgccttgaatttcataaaacattaattcacaatgggggtcagaatgtactcttgttgaaacacttcttgtaccattttatgttcatattatgtttgagagggtaaaaatgtatgagcagcttaactgaagtagaactattcatgatgcttttcacacattgtggcataagatgtaaagttaagtttgtaattaatgttaatttctgtgcattttaatattcttttataattattaatgttaatttctgtgcattttaatattcttttataattatgagcattttaataaattcatttttacaaacaaaaa

SEQ ID NO: 113 - DNA, 1490 bp, Homo sapiens
  nbla23630
actcagtatgtaagtagatgagatttgttgattttgcccctaaaacgggctttagtcattttaggagtgagttgcacaaaaggacctaaaatgcattgttttttgccttcttttaagagatggggtctcgctctattgcccaggctggagtgcagtgtgctatcatacatagctcactgcagtctccaactcctcataccagaggcatgtgtcaccatgtcttactcctaaaatgcatttttaaaaagcgaatttttagattaaagtgcctagtttctgattaataaatagaagatgaaaaaagtgggcgggaaaagcataatcttttaagatttgtaattttctgtatgtgccacatttatgtaaattaactataaaatatggaattcaggatcatgctgttttgcatgtactttataggttatatagcatgaaacatacaaattatcactgttctttagtatatagctccttgccttttcttacatagatgcttaatttaacaattacctatttatagttcttattattgacgggaatatgattagaagtaccaaaactaaaaattccattatgtactgtttactttttatttaatattacatgtttttaccttgttgcggtatctttggccttcacacacacatgtgtgcgtgcacgtgcatttcattaccatgtagacaagacagttattgcttatagtaatttacccatttgagggctaagtgttttaagctgtggttttataagcaaagctgtaagtaaatgtaatttattttagaaagatattatttgaaatcaattttgaagaattgcactatttgataatgctgctactacatgagataactctggggaattaattttatgagataagatgaatggctttctagaaggtgttgctttttgttttttctttttcttttttacatttcatcttagaaaaagttgcttatattcagcaggttggtttgtcaaattcagtgtttgagtttgtttctggtcagttcagtagctgctactttagcaagatgtggcctttcacaaaagaggtaagagtgaccaaatagaattttaggacaataagtataggaaatatctctttatcgtaagataagaaacttgaactttttaaaggaaatgtcctcttgaaaagaacatttctgactgcatgcagaagggtacttaagacatatataacaggccaggagcagtggctcacgcctgtaatcccagcactttgggaggcccaagtgggcagataacctgaggtcaggagtttgagaccagcctgaccaacatggtgaaaccccatctctactaaaaatacaaaaattagccaggcatggtggcgcatgcctgtaatcccagctactcgagaggctgaggcaggagaatcgcttgaacccgggaggcggaggttgcagttagccgagatcgtgccattgcactccagcctgggcaacaagagtaaaactctgtctcaaaaa

SEQ ID NO: 114 - DNA, 3442 bp, Homo sapiens
  nbla23754
cttacaaatgtagcagttgtgaaagagtcttcagtcgtagtgtccaccttactcaacatcagaaaattcacaaagagatgccctgtaagtgtactgtatgtggcagtgacttctgccatacttcatacctacttgaacatcagagggtccatcatgaagagaaagcctatgagtatgatgaatatgggttggcctatattaaacaacaaggaattcatttcagagaaaagccctatacgtgtagtgaatgtggaaaagacttcagattgaattcacatcttattcagcatcaaagaattcacacaggagagaaagcacatgaatgtaatgaatgtggaaaagctttcagtcaaacctcatgccttattcagcatcacaaaatgcataggaaagagaaatcgtatgaatgtaatgagtatgagggcagtttcagtcatagctcagatcttatcctgcaacaagaagtcctcaccagacagaaagcctttgattgtgatgtatgggaaaagaactccagtcagagagcacatctagttcaacatcagagcattcataccaaagagaactcatgaatgtaatgaagatgggaagatatttatcaaattcaggcttcattcagcatctgagagttcacaccagggagaaatcatgtatgtactgcatgtggtaaagccttcagtcatagctcagccattgctcagcatcagataattcacaccagagagaaaccctctgaatgtgacgaatgaagaaaaggtattagtgttaaactcttaatcgactcctgcaaatctataccagtgagaaatcttacaaatgtattgaatgtggcaaatttttcatgctattagtattttcataccttagtcacatttggagaattcacatgggaataaaattccattgctgcaatgaatgtgaaaaagccatcagtcaaagaaactaccttgtttagtatcaaattcacgccatgcaaaaagattataaatgtaataagcatgtatgtgtgtgaggagattcagtcataacccaacgctcattcaacatcaaagaatttatacctaagagaacttatttgggtgtagtaaatggcagatctttcaataggagtttaactagtctttgtcatatcagaatatccatagtagacaagaatttgatgtaacgcaaatggaaaaactcgacaccacatttcaggctttacccaacatcgaaataatggagagaaaattgttgattatttgtttatgaaattgttaatacatagtcccaatctttttcattgcacaaaaatctagggttgacttggtaaatgcagtgacattttctcatggagttcctttatttaatatgtattctaagtaggtacgtttatttttacttttttattataattttgatattaaaaagaacagagatggggtcttgctttgttgcccaggctggtcttgaactcctggcctcaagcgatcctcccgcctgtcctcccagagtgctggggttacaggcgtgtgtcactgtgctgggcctattttatttatagaactcatttaagctgtttttattttaatatgccctataaacatttttatattttttgaaattggttcttagtgttcacaacttccataagatactgctaatgcaccagtattaaaacacatcgacgtaagtagctcatttagctttttctgctgttcttggcccaagttctttccaaaaccaactcttaggcctgctctttactagggatcttatgtcgtattgctttacagccacaacacttggattcctgttgattaacttctccattctcttaagcacctttagaagatttagaagtttcctagttttaagtgtttcaccagcaagtattccatacctacttgatgttgctggtctggtgtcttatttcctaaagtgaagcatctttttttaaaaaagaatttgattgacaatatatccagtccaatataagtatgaaggattctctctcctgagattgtagcaggcagccaaacattttcaaatgatgcccaaggttttagctgtcttgtgtgcatccacagtctgcgaagaagacatgataaggacatcagggagccaacaagactcctaatagcctcactacattcatccagtgcctattctgcatgcctaagcttagagttcttttatatacctctacggccagcaaaatgctcaggtctgctcttggtagggtaaacataaagaagatacacaggccgggcatggtggctcacgcctgtaatcccagcactttgggaggctgaggcggatggatcacgaggtcaggcagtcgagaccatcctggccaacatggtgaaaccccgtctctactaaaaatacaaaagttagccgggtgtggtggcacgcgcctgtaatcccagctactcaggaggctgaggcgggagaactgcttgaacctgggaggcggaggttgcagtgagccgagattgcaccactgcactccagcctgggcgacagagcaggactctctctcaaaaaaacacaaaaaaacaaaaacaaaaaaccatacacacacacacacacacacaaatcagcatcataagggaatgtagccttccaacagagatgatgctgttcgtatgttaatctcagagacagtatttcaagagagtggcaggtctgttcctggtaaaattttaaccattaggattgcagataaatgtttgaattctgctcctctctcatcaatccaggacagtatttgaagtgtgagggctttgtgtatagttgtttatccattaccacatttttgtattttaatagtctacaggctatataaaagaacatggctttttgactgataaaagtgattacagatgttggctcaagttcagggccaccatcatatacctaacaagagttcatgattctttaggtaatgtcaaaacattttgtatttttccatcttaagctttataacattttgtgagtaagacaaatgttatttaaaattcttgttgtcagtccagcaattgaggctttcatagttcagtgttataatattcagtagggaccctcaacaaatacataaaaatatgttgctcactctataatcctcctatggctaacctctaggatagttctgccactatattttacttctttgccatcagcaagagtaggatttcatcaaggcaaggtaggaatctaaatgaaattgatatataaatgaattgatctaaatgtaaaagcaaatgaaaaatgcatgtgttttttcctgtcaaacatgtatacccttatgtatagagaccagtagtcacgtatggtgactgaaacaggattatgtaatccctaaaaagcagaatatgtaaaaatcacatgtatgcgtttggtttaggaatgtgcttttgtacttccacttgaataaaggtgtgtttggtattctgaaaaa

SEQ ID NO: 115 - DNA, 2384 bp, Homo sapiens
  nbla23892
atttaagttgaatgcttttgttctttcttaaagacttataaattgcttgcaataaaataatgcaaatgaaaacacatgagggtaaaataataaaataagataaaaattatttaaagcagaagccgctagtcagggttagtaaataagcttagtggagttcatgaacccactggaattccatgtatatttttgcatatctgttttatggaggtggtccttcatacggccaatcaattcattgattctgagtgatttgattatgatttgcttgcctaaaagaataatgtttagatgattttgagcatctaagaaaacctgatagttataattttgaactggtttgccttaaagttcttgaatataatttaggaaggtatgttaagacacacatatgtgtgggtgtgtacagggggagtacaaaaaaaaccacatttttaagttcagaaaaaaaatcattgcaatttgttgtaaacagcatggactaatgatacaggatgatgttggttgaattttcaggactagcaatgtaactttgcaatggatacgtagatgccattcaaataagtgattctgttatttatcctgtttttttaaagtaaaaatattaaacataacttagtttgtataagaaaaaataattgcaggaggtaaatgtaacctgtctgagataacacacaaaactctgatgattgtattttggagttaagactatgaagctaaaaaatgtgtgtgcacataatttcaaatattaggcccaagtaattttattttcggaactgctcattaattatgggagcactcagtgtttcaggaagtgttaagacttcagggtttcagcaatgaaattgataaggctcttccctagatctaagaagagacagacaataaacattcaaaagcaagaacataagatactgataaattctaagaagaaaacccagtaggatgatatacaggggtgtgactaggaggtcagaggaggttgctctgaggaggtgatgtttatgcaaatctgaatgataggaagcccagcaagagatctgggagcagagccttccagggaaagggaaggacctgtgcaaaaccccagaggcgaagtccatctaggcttgctcaaagacaagaaagaggacaagaacattaagtgtggggagagtggcaagaggcaagatcatcaggcaagggcgcctcagacaagaccacgccaaggggagagcacagggcagagcaggactgtgtggaaattccaacgtgaatgacttccaaaatcaggacacaggctctctccccagcctgacctcttctggtgcttaactaacttgttagcaaaactccttggggcacagcactgagtcctccagccaggctgcccctttgtattgacatggcagggatacaggaggcacgagagactgtaactttctagagttagaatgtctctagtaactctagagacattttagtgctaacttacaattgatctggcaaagaaagataggcagagctattaaagtgttcaatttccttccagagagattcttccattttctctcattacaaaaccagaagatcagctgtgtggggccatcagctcccagcctaaggtcctataacctgaagcttgaaggcaatcagtacctctgctttataattgatcactttgaggagccaaaggaaagagtgaaagattgggactgctttgagtggagatggcactgaactcgttgtaataactacaaatgcaatttaaagtaaaagcatgagtatataaattgaaagggcaggtggacagaaagaagagactgactcctagacaggtgctgagaaagcagtgtaattaaaaagataaggaagggaaaggagctacaacatataccacacacacacacacacacacacacacacacgttatcagacattcaaaaaattagatcttagactccacaatacaaatcccagaggacaatggattacagtgttgacaggggagaaatattgtcataaaatcattgcatacttagttatgttttcattgttaaagaaataaacagaccattttgaggtagttaaacctcagagaagaatagcatgtatttactcttcttgaaatctatgttggctttatgccccagctgagataggaatcaaaggtgaggttgaaaataaatagggataatataaaccgtccaccagattgtgttaaatctaaagaatcgttcagtattttattgtatctcactgtatgtgaaaagaaacaagtttcaccaaacaatacttagccttattttgtatatgcagtgcattataatattttctattttgttctgtctctttttttgttcatgcttgacacaaaacattaaattggttttgcaacctaaaaa

SEQ ID NO: 116 - DNA, 2971 bp, Homo sapiens
  nbla23956
atccagataatatttatataatgaatttctaatgggagacctcatgctagattctgaggatttaaaaaaataagttaaaacatagttctttgtttttccatggagaaagaattaactctccctgactgaggcttcagttccatttcaaaaagacataacctttaaaatcattggttaactctttgtcaatgtccctaacttacttaatcaattgcacttcaatcgtggttcttcctgattgtttgcttacttttttccaaggtattgaagtgtaaaatcacacatttctgtcttcattgatgctactatatatctatatctcagcttggccaaaactttctctgaactctgctacagtctaacactcttgctatgtaactctccttccttatccttctaggtgtaggaggtcaggcctgtatccaatgtctattcctgttttctcctctttatacttcacaagcgtttcctctaatattttcctctaggtttaatcctgttttgggatctgactcttgaagaaccaaaattaaccaaatcttcatcctgaaaagtgaacaaatataaaatgcatttcagttcatagccaacacataaataatctctgctctactgcctactccctctttttctcaagtctcaactagcttcaaaataatttttaaaaagtcagcctcctcagctctgtgaattcctgtacatgccagtctcctccatttacagccgaattgtaaagattaacttttacttaaaaacctcaagttcagtgttgctatatccctggggcagctactcacttgtattcatgtgatggtaggaagaaggtgaagaaagatactccagagagctaaatgcatatattcctaggtgcatctagacacctaggaataatctggtttaatttgttttaatgtacagttgaacaaggctaggagaaaatccagaggctatacttcattagtatgtgctgattacctccaatgaagtacttatacccacctgagtttgccagtcgtttacttcttctttccaatagattgggagtttctaaaggatacattgggtctattgtatctgtaattctagatcttaatgcattgataaagagttcaattaatactagttgaaagaaataaaagactaaaacagaaagacggaaaaaaggaagcacagaagtatagttttgtgataaaaagaggacatagaagaatgctaaagagtgatagttccaaaggagatataaagataagatttttcagtggaagaggttatagatgtttaagggtaaatagagaagattttctggtggaaacagaacttaacccaaattttgtcggaatagtaagactgctataaaggatacacaagatggaaggctcttcaggcaaggcagagaccgaagactcatatgtaaattgcaaacttaaaaacaacaatagcaacaatagtcaagacctgacacaacagaagaattatattgtgcaatacaaatctttgttttgataaggatactaaaattatcttggccaaagtgccaaccaagcaagcagtaccagcaggggagcataaccatttcatattcttagatacagatttgttatttgtctgtttatttattttctctgaaaaggtgatctactcagacggtttagaacctgcatatgcatggggcaggtggatgataatctctccctaaccatttggattagctgaatcaacacggatattcaaaagactgaagaggttgtggccagatcactttcaaatagaattctacaatgttcaaaagaattcctttcactgtgaatttgagaaaagacaaaacagtctctgtttgtacacttgcaaatgacagaaaagctgttacaagcttcctgtcatattttgaaagagtgttagcattgggagagaagaaaatttggggatgtgaaggaaaaattctcttggtagaacagaaataatattttcaaaatcacttaagaaagataaaataataaagatgccaggactttgaaattacatttctaaatatttggtatgcttgagaacagtgagttagattgctagaatcttgccttgctacatctcaatattaaagtatgagaaaaaaatcaaagaaatccctttcactaatattgatgttcttacacctgatataacttaaatatttttcctagtagatgttgacttgaggcttttctatcaatgcagccacataactgtgttgttacacaggctatagaaactaacagattattataattattattgattattaatttatagtgagccctcaaaaataccaatatcttagtttgttcttggagtctacaaaataaatttaatttgttttctatatgacagtgtttaaatatttcaagagagtatgtgccatctaagtcttttcttctttaggcagaacatacatcctcctaattctaataacacttgaattgataaccttctatttattattagatttttaaagcagcactcccagccccttcaagttaaaacaattctccaggtaaattctggtcaatacagtataaaaagtaaagttctttttctggactcaaaattctataaactctttatggacagcttgattttgtaatgagcttaataaacttagaaaatccatttaaatcctatacttaataaataaaacaaagcaaaacatgaattgctgttcagctagcttttcctcacctgtacatttgtaatgatatttttctcatccacatgggggccttcatatttattcttactatcatttttaattttctttttctgtgttgtatactaaaacacatctgaacaatgattccttgccctatttagtgaattggaagcaaatacagttttcatcaacttgtacagctgaattccatgaacaatttcagggatgcagtttgcaggattagttgaagaggagaaaacctggaggcaaaagtaaactctttaaaaa

SEQ ID NO: 117 - DNA, 1745 bp, Homo sapiens
  nbla20365
ctttccctcattcaccaccttccagggtttcatagaaaataacttgttacaaaatcagttcaattctaatgtggacatagtggcatgttcataattagacccatataggggacactgagctttaaatcgttgattctaaactctatacattaaaaaaattcagcccaggcccctcaaagcctgagaaaatttaatttgctcttaatttaatgttccaaaactcactcttggaaaaatgcctgttggaaaactacaggtgggtcacatgtgggggctgtctccgtgacactcaggattccagtcagaacctaatcctcatatctattgcctacaaaaatagaccaagaatgttgctgctcttttataatcctttaaatatttaacattcaagttttctttgtcttaaattcagcctcttcctaaaagcaaaaaagaaaaaaaaaacctcacagaattgtgttgagatccaccgctcacacgccgtacaccacccagtggcttcattctggcttagccgcagaggcaagaaagggaccccacttgctcccatgcccacctcaagaaaaaacataaaacaattttttttaaaaaagaaaagaaatctacctcagttgacaggattccacctttagggtttcttcaacttttaagtcttacctgttgagtgtaacttttgtagcatcttgcttttccaagcaagctagtgaggcatgacagagcagaagtctgtaaatgtccctgtgatggacctctttctagcatgttgcagttttatttttaataaattggtaagtgaaatgaacgtaaaggtaattgtgtacgttttagacatgacaatgaaaatttaaaatgtagcttccatacttgtgcataattccaaagtattttattttttatcaatcagtgttaaatagctttttgtacaggcttcaatccatttttcgaagtgtgctgttttttaatgaaagtaactataatcttttcacatcccatggaactgccgtttacacattgcaactttttaaacttaaccatatttttcaaaattaacgtttttggagggagaaaaatccccgcttgctaaatgatactaaaccgttgtttgggctcttataattaggtcctgagattttataaaaatttagtctgtagctttttaggttcttcactagagttggttgtacataaaaataataaagaatataaagtatcccaaaattcttttaaagtctggatttttccgctaatatgtactttagagaatattttgttcatgcatacttccacgttaaattgaaaatgtcttcagcttctcttggtaaatgtgaaccatttgttttttattgtgcttgggggagagggtattttaatataatttttgcctaaatcaagaagtcccctctgaatgttaatttttaaatgtcaaaatatgatgaacgatatatcttgaaagtgagattgcaatatgcttaaacttaagtggtatttcaaaaacgagaaaattctggaatttgtcatttgaagctccataagagaaattgataggacttcgtttttgatcagtctgaatagataccaatgtcattgtgtgggaattttttttaacttgtttatgtattattttgatccatttttctgtggcatttggtgcaataaaacttttgaatttatcttgaacattttcctggtgctgcatgcgatttgttatagttaataaaatgtagaggtctcatttctaataaaaa

SEQ ID NO: 118 - DNA, 929 bp, Homo sapiens
  nbla20378
gtaacaaattgcaagaaaaacaacttaatcttccagtgactaagtaagaaaaactgttgtcactattaaacatgtaggaaattgataattattacaaacaaagcaatactctaccctaaatctagacaaatcactggacagatgataagattttcagctttctcctttaaagagctgtgccaatgtacagatttttttgtaaacatgcaaagggaaggttacaaactccttaaactttaaaaaaccataaatcctttctttgctacttatattctatgccaattataatattccaagacttacctttcttcagaatgcttacatatggaaaggtttatttataaatatttgataggtaaatattccatatgtattttctagcccgtctttctctgtccctccctcaaataacttcattaccctctcctttttaaacgaaatatcttgataataagaaaacaaaatcatttttttgtgaaataatacatatggacaaaaaatacaagttgtattttacttctggttcattaaaatattgtgtttagttggattttttcctcctttattttcagaaacataaaagaaattgttttatttcctaaaggataaaattggatatagcctctttagtagacactatcacagttctgttgtttgctgtgttcatttgcttaatgaattgcgtgagaacagtcactgtaatgaaatatgtgtgctgggggtggggggaagggcatgggaaatgttttatgaaaaaaagttataagcctaatactatgaagtaacatctaatgcagttctttttaagtgcaatatatttatttctgctagaaatatattatcaaccttatgtaatatttgaagcattacatattatttgtaaacagcttaaaattatatattaccccaattgtacataagtacaaaaa

SEQ ID NO: 119 - DNA, 1972 bp, Homo sapiens
  nbla20511
atgtacacgtctctcaaactatgaagagaagatttgggaggagtatgagaaaatcctcaataccaaactagcagagcaatacgagtcgtttgtgaaattcacacatgagcagattatgcgaccatgtgggacaagcccaacaaactatgtgtcttgaagctttttgttgcagatctcggtaccaggtttgacctcaaggcatggttgctatacattttttgcaactgtttgatatcacatttcagctccaactttgcatcctgagaacattccaacgtttctgcaggtccattttatacgacttgaaagaccttaaaactttctggttgccacaggtatatctttcttttctgttcatccagtaaatagtcataccctactgtgacagatttttccaaacaaaaatacctggagcagcagtgtagcaaaatatgccttcagtggcactcaacaaatggagtttccccaagcacagttctgtaagaagtgtgtgtgagagtgtgtatgtgtctgtacatgtactttagattatggtttgtattgtgcaaatttttttgatcttggggattctggctgtggatttgatgcagaaaattatggttaaaaactatggtctacagaagatacttaatgctttgtgactatataaattgtaacagtggattgttttatgtgtaggtattattgttaaatatggggactgttcaccaggcacaaaataggaatcataaattaggatgcaggctgggtatggtggctcatgcctgtaatcccagcactttgggaggaggccgagctgggcggatcgcttgaggagagttcgtgatcagcctggccaacgtggagaaaccctgtccctactaaaaatacaaaaattaggtggacatggtggcgagcacctgtaatcccagcttctcgggaggctgaggcaggagaatcacttgaaccagggaggcagaggttgcagtgagcccagattgtgccactgcactctagcctcggtgacagagtaagattccatctcaaagaaaaaaaaaaaaaaagtgaagatggccattggctgtggttatgacaatacagtgaaagtctgttgtcttagatatacaaatacatagtgagaaattagaacaaactggagactggcctttgacacatggactctgcctagctgtgttagaaaaatatttaactccaagccttaaaattcccaaatggagttggtgcttacctcattcacacaatccaagagttcactgggtcctgaacctctaaagggaaaaggtctcccctggagcaggagcatcagagtttgctcgggggcataaggtaggtgagtgctgggccgaggcaggctcccctggcactgctagttgcaggagcactttacctttgtatcagttactaaaaacaaaatttgaatcctttggtcaggttcccccaaattattttgaggtagccatgtttaagtgcttgagcttttgtgttggcaaacccctgcccaaggttgctaatagggtattctgccccttgtttccacagctgaggcacagaaagtagcctcttttgtgaggagttgggagttaagtatacatttatttttttaccatgatttgttcaggaccacattttacaagataccttgtttcctttattattgtttctggaaagtcctattcatattattttatttgaatatagaatatagtttttttaaatgagggcttattttgaaaaattctgagcttaattcaaatttatgccaataccttcccaaataaggtaatagtcaaagacagatgttctgatcaaatggcttagagatagtcctggaatattcatattcaaagattccttattaatgaatgtctttaacttaaatctacccaataattgcaacatggttctttgtacattttcattatatggtgttaacaagcttcactgcaaacaaataaattacttaagttaaaaa

SEQ ID NO: 120 - DNA, 1806 bp, Homo sapiens
  nbla21039
ttggagcggtttctgaatttgttgtttgtttaatttttttatatcctctattccttaaccatgctgttaattattgccattttatcatttgctttactgtgtgttaagtttcaatgggggtaaatgttactcttcttttttaaatatttttggctatattttttcatgtattctcgcagataagcttcagttatgttttggtcacattccaaaagaaattctattgccattttgtttggaattgctttaacaatatagactaatttggggagaattaccaactttgtaatattaaatttcttattcaggaacttgtcatgtgttaaggttactgaagacaatctccaaatgttctttagtaattttgtatgttttgcatatttttattaattgtattgttagatattacatttctttgttgcatttgaatgggatcatttttccatcattttttattagtggctactccttctggggtcaagctatttatttttgtgtttgataacttttttgaactctttcattaatactccctagttgattctcttctaagtagccaatcattcttaagtataattaatggtgatttttctctcttcctttataatatttatacctcatgtgttaaataaatgatggtaataactttgcccttattcctgatttgttaggtatgccattaaattttaccagcttttaaatgttagctcttagactgaaatacaggtctttatcatgttaaagatgtggtttgatggttcaaatatactaagcattttattagaagttgttcaattatattaagcatactctaggcaactagaaatgatcatgtgattttacttctctggcctattatcacaataaattatgttagtagtttctcaatactggattatttctgcatgagatgtatcctgttaaataatggtggtttttcccctttttttcttgtaacaatgttgaactcaatttcttacattttatttgggattgcatttatatttatgaataagattgggttgtagttttacatttttgaattctacctttatcagcttaaaaacctagattggtacatagcatatgaattgcctattctttggggtctggagaaactcacccataacattgtttaggcctcaatctctttaagggaggatgagtagaagacaattctctgaaaacttaaaaaacctttttctatggttttactgtcacttcttgagtatcaatttaaaaaatcatatttttaaagaaaaacatgcattttcagagaattttaaaatttgttgtctatatataattataattaaaaatatttttctctgtatctctggttattgcttctttctcatttctggtccttttagttacttttttcctttcttttattagacttgccagtctttttaaggaaccagcacttgagtatttcatcagttctattttttctatttgttataatattaatataacttttcatctttaattccttccttatttttaatgtttattttgttgctttatgaatgttttgtactaattgatggcttagttcatttattttcattttttaatttaataataggacacgtaagactataactttgcctttgggcacagctttgactgcatctcaaaagttttggtatgtagtctcttaattgttgctatttaaaaataatggattatattactgtttttattttatttttgatgtattatttaggatagtattgtgaggtttttgttatttgttaatcctactttctttttaataaagaataaacttattaataaaaa

SEQ ID NO: 121 - DNA, 2614 bp, Homo sapiens
  nbla21107
gggtccagatttttcccctttataagctgttttcacaggcactgctgtttgtttttcctgaaccagtgtattcatctttcctgtgtccagaaagttactttatctgtgatcagttctggagtaaaggatgtcatgtcatagtctgtgctcttgcccacgttggaggagctcctagcataatttaagcttaatgtcaaaatgcttggggttgcaatctaggttctgccatttgctggttgtgctgctttgggtagagcagttgtataattcaatgagatattgaatggctagcgctcgacatatagtaataactcagtcaaaataattaatattttttattatctggaagggtgcagtggctcattcctataatcccagtactttggagctgaggcaggtggatcacttgaggtcagaagttcaagaccagcctggccaacacggtgaaaccccatctctgctaataatacaaaaattagccggatgtggtggcgtgtacctgtagtcctagccactcaggaggctgaggcaagagaattgcttgaacctgggaggcggaggttgcagtgagccaagactctctagactgcactctagactgggcaacagagtgagattcaatctcaaaataaattaataaataaataataaaataaaataaaataattagtattttctagcccgccacttacccagttaggtatcccaggactttgttagtagcaagtagcatacaagaaaacaacagcagcaacaacagagttctgtgagcacacgagttaggaaaacatcaggatgaaaagctcacatagactcctttatggcaggacttagtctctaaaatgttacataatgtgttttgtagagaagagtggaataaacgctaattaccaaactatttggccttagaaccccttttgttttagggtggcatggtagagagagtgatgttccttagaatcccattaggaaagaaattccagggtggtccacttcccttaggaattctaaggtattctgaggagcatcacggtctctatcctgccatccttgaaaacagtatttgaggccaggcacagtggctcatacctgcagtcccaggactttgggaggccgaggtagacagattacttgaggtcaggagttcgagaccagcctggccaatatggtgaaaccttgtttctactaaaaatacaaaaattctctgggtgcggtggcacatgtctgtaatcccagctacttggggggcttagccaggagagttgcttgaacttgggaggtggaggttgcagtgagccaaaatcatgccactgcacttcagcctgggcagcagagcaagactctgtcaatcaatgtatcaataaggtcttgctaaagatgataaagcaaattagatgtggaacaacgttagaagtgcaggttcctctctgcttcctcctgcacgtgcacttctcaaagtctgatctttgatacacctctgtcagcatcacctggggaggggatgggtaggaacacagatcacagacacagggcatcagaatctcctgtctcagagcccaggaatctgcatggtggcaagtcttctgggtaattttctagtaagctaaattccggaaaccactggactggaccacccatctctgtagctatattgtgtgggcagaactgaggttgctgctccttccaaaaactctggtgactttggaaaaatggttgatgatggctcctcaccacctctctgcctgccccatgaccctggaggaggtgtgtatcttgggagaatgctggaggccttcctgggctttcacaggccagcccgtcatgcagagtctctccagagaccgctccctgccctccatggtcactgtgggagctatgtgtccctacgatccctggtaatgctcctccagggaaacctgtgtgtgcggtgcaggggagattagttcgaaatggagagacacgtacttggggccttgccaagtcgctctggagagagcatggcgatgcttcggtttccatggaaaccaggtgactgtaagctcacctttggcccttgaaacagcctccagcttctgggaacaactgcaaggctgctgcttactatgagaggggagagcagccacagagaagagaaaaccaactgctgattggaaaacaggctcagttgtctgttttgaactgcaagaaaagttagaagagtgctccaatccaaagatacagaaggtcagatgtggggcaggcaactagcccactgtcccgatctgtattaagagacaccaccatcaaggtggctcccttctctaggttttctactcaaaaagccttttttggctttttgagtcgaaatttatgaacatcacaggcttagacagtttttttgactgttcctttattccctgctaaaatcgatattccatgatatccagacattgccatgctggcttcaattcccactttgtgtgtgttcttcctctttctcatatgtgagcagctgtggatagcaccgcgcccccagttttgtaaagtaagctttccaaagtggaaggatcacttgcagggcaggagtttaagaccaggctgggcatcctagggagaatcctgtctcttccaaaaa

SEQ ID NO: 122 - DNA, 1779 bp, Homo sapiens
  nbla21367
aaaaaaaagttttcaggttcctgtgtcttcccgttgagttgctcgctccacggcatggaggactaggaatcaggagtcagtggccgtatgctggaggctggagccgcgggagcgcggctcgcctcgctgcggttgttggcagcgacggagataggagtgcggctggagcgatgtgccaggtggtgccagtgccagctaatcacctccctgttggcagcaccgtgaacactgtgcacctgtcttcagatggcacttaaagcagagaagcctgctgtgtggctgtgggagtcatcagagaggtggcagtggaggtttgttatcgacccaatcattacatcgctacccaaggctcatctggaacttctggactcaagtgatctgcctgccttggcctcccaaagtgctgagattatagggatcatggcccaagtaacaatgtccgccctggccgttgaagatgaggagtcctcagcaggatggtggtgacattcctcatgtcagctcttgagtccatgatggggtttcacaatgttggtgaggcttgtcttcaactgctgagctcaagtgatctgtctgccttggactcccaaattgctgggattgcaggattgttttagagtgtggatagtgaagcaagaatgtacgctcatttactcaaggtgttgaagaagaagaaaaggttgcagagatgcattaaataaagtctacaacccagggaaagctttacaaaaacccacagaggtaactgtaccatatgagaagatgctacaagaccagtcagctttgatagtacaggggcttccagaaggtgttgcctttaaacaccctgagaattactatcttgcaaccctgaaatggattttggagaacacagccgggatttcattcattattaagagagatggggtttcctcatattgtccaggctggtgtcacactccttggctcaagcaatccacctgcctaggcttcccaaagtgcttggattataggcatttccctggaagtggcagctgtgacagtaaaggaagaatcagaagatcctgattatgatttatatcacattcaaggagccagctgaggaggtgtcatgcaacttgctgccccagccctccccttctaaggaactcccacacctgccctgtcttcctgctacagtctctgagaaaagccctttcatctgtcaagaactacaaaagtcattctttaagcagtgctaaataaacaatgaaacagacacaaagttaaagttacctgatccaaaaaggagtgaagcctagaccccagcccactgactcagtctctaagtcccctcactcaaatcttcaatcaacagtggagatggctgtgagctcttctgattccagatgacaatactcctgcctttaattccttgatatgtttaattatgtaagtaaatttaatataaaaatcattgcattagagttcgtggtttttatacaagattcagtgtgagatcaatgtcatacttccaatttgtcacacttatagagaactgagaagagtcacattatttaaaatcttagcaaatgtgcataattcctttggataattttaaagtgataggattggatcacatatgatgcaatttcctgggtctcttttgtttttagatgtttttatctctcgtattgtggatctcatatttatgtgaataattatcagaagattttatttctattatgcatatttagtataaaatgatcatacagtgaagagtgtgtaaaatcaaaataaaatgccattcatcaccaaaaa

SEQ ID NO: 123 - DNA, 2942 bp, Homo sapiens
  nbla21790
gatattttgttacaagattatcctagtttttagagagctcaataatactaacacctcatgtatttcaggctgcttcaggtctaattcaaccataaatttaaatggttgaaattctgattaattgacaagttaagttgggaggtaaggaacaactaggataccatctactatggtgtgtaggcaagtgctccagattgtgatttctttgagtatctggggtcgtagggaataatcactgtgcctgggtaagtcaggaagagatcataaatgacaaagaagtcacccttgtaaggattgagtatgtattagcagagatggattcatctgaaaatggtactagatggtgggtgcctgcatcagtattatttcagtatattttcacatcaagatagttgagtaagaaatgtcatgtgattaaatccaagaggtatttattgacctgtaatttgccagacactgctaatcccttgtgctacaaaaatgagtaagaaccacttattggtgcacacagtctgtggaagaaacagaactgcaaacctgtcattctaaaataataggtactaagggactgaatcagtagaagttcttcttgtgtacaccagagaaaagtgacaattgagttgatgcttgaaaagtgacaattgagttgatgcttgaaaagtgacataatggaaaagtgacaattttgaagaatcactaaattggggagtaaatggaaagagaaggattaataatagctttagtgaaaaaagaggataaagtgaagttgatttgtttatgattttagatagggataggagccaatagagaaacaaagattggaaatccagagaagagagtaattggtaatgcagtgttcaacaggagtcaggagggagtggaattaggagtactggtttgaagaagagaggaattatcttctgagactggagagaagagagtaaatatttcattctcaaaaactccttgggataattgggttttttcttgtgcccactttttaagagtaacacttgaagtaaatctttttgtttagtaaggcactaagggaaaagtcaaattatgaaccttcagaggaaatagaatgatgacctaatcttgcatattcttaggggtagagaagatgaagtccatgtcacagcttgcagttttgtcaagacggtggaagccttcagagatgaagttggatcccttccaggaggttgtattggaaagcagtagtgtggacgaattgcgagagaagcttagtgaaatcagtgggattcctttggatgatattgaatttgctaagggtagaggaacatttccctgtgatatttctgtccttgatattcatcaggatttagactggaatcctaaagtttctaccctgaatgtctggcctctttatatctgtgatgatggtgcggtcatattttatagggataaaacagaagaattaatggaattgacagatgagcaaagaaatgaactgatgaaaaaagaaagcagtcgactccagaagactggacatcgtgtaacatactcacctcgtaaagagaaagcactaaaaatatatctggatggagcaccaaataaagatctgactcaagactgactctgatagtgtagcattttccctgggggagttttggttttaattagatggttcactaccactgggtagtgccattttggccggacatggttggggtaacccagtgacaccagcactgattggactgccctacaccaatcagaagctcagtgcccaatgggccactgttttgactcggaatcatgttgtgcactatagtcaaatgtactgtaaagtgaaaagggatgtgcaaaaaaataaaaaaaaacaacaaaaaaagctaaccttctattagaaaaggggacaggggaatgagtaaacttcttttattgcggacaaatgtgcacatagccgctagtaaaactagcctcaaacaggatgctcatagcttaataataaaagctgtgcaaaggccatgaatgaatgaattttctgtttatttcactgatgcacacattacctcattgacaattcagaagtaaatccaacgtgtgttgactcttggaaagcagcaaaaacaggagctgaagaaaagaaattcttggaaccagccgtaacccagtaaggaattgtgaagttgtgtttttattttgtttcattttttgcagagtattaagaacattattctggaacatcagaacgtttcccttagaccgatcccagcaggtggcagctcagattgctgcagtgttgtaattataactgattgtacttaagttatggatgtagagaatatgtttcattcatttattcagcatgtaaataaaattgatcctgttgagttatcataattgcagttcaactatctgccatgattattcttttcacgtatcattcattctgtacatttgtgtacattgagaagtatagcaatctatgtaaatgtaatcctcagtgaggttcctcagtgctaggtcccataggattgtcgttgcccttgttaatgaggtttctctgttcagcggcttcaatttttttctctttgtacatctagttttgaagatttacttcaagtttgaatcttctagaatgcttgtaagtccagttttaatttttagagtcaatttgtagttacatgtagtttaacttttgggaaacgtcttaacattgttctgaataaacttgctaatgaggtcaggtcatggtacagactgatgcagtcaacatgatttcattgcagagtttattagtatcagcaagtttttgctttgctaaataaaagtacccaatgaacacaattctacataaattttgacataccatctaatttataaaaatcaataaaaaaggttttggtaaaactttttcatgccagatgctgtttacaacaatgaacatgccaataaaacatttgttcattcaaaaa

SEQ ID NO: 124 - DNA, 1679 bp, Homo sapiens
  nbla22253
ccgtttgatgttcaggagactggcgaaggctcagcaggagcttcaggagccccagagaaggtccctgaaaatgatggctacatggagccctatgaggctcaaaagatgatggccgagatccggggctccaaggagacagcaactcagcccttgcctctgtatgacacaccctatgagccagaggaggatggggccaccccggaaggtgagggggccccctggccccgggagtcccgcctgttagaggatgatgagaggccccctgaggagtatgaccagccctgggagtggaagaaggagcggatttccaaagcctttgcagttgacattaaggtcatcaaagacctaccttggcctccacctgtgggacagctggacagcagcccctccctgcctgatggggacagggacatctccggtccagcctcgcccctccctgagcccagcctggaggacagcagcgcccagtttgaaggaccggagaagagctgcctgtcacctggccgggaggagaaggggcggctacctccccgactctctgcagggaaccccaagtcagccaaacccctaagcatggagcccagcagccccctgggggagtggacagatccagcactgcctctggaaaaccaggtctggtatcacggggccatcagccgaaccgacgccgagaacctgctccggctgtgcaaagaggccagctacctggtgcgcaacagtgagaccagcaagaatgacttctccctctccctcaagagcagccagggattcatgcacatgaagctgtcccgaaccaaggaacacaaatatgtgctgggccagaacagcccgcccttcagcagcgtccctgaaattgtgcaccactatgccagccgcaagctacccattaagggagccgaacacatgtccctgctctaccctgtggccatccggactctttagatgtgaagccagggcactgtgatagacctgtacccagccctgtgcccatcacctggctgagggctgtggctcttgccagggacgtgatctttcaaacctttcttctcctgggatccagtagaagctggagattccttaatttattctaaagggaaagggctcctggggccttggagtaaggggttgtctggagctggggaaagaggaatccctggagagaaaggatagcccctggaggaagggggttccagagctactgggatggtagggagtttcagactggcagctccggctcctttccgaccttagggcagaggtggtgacctccaccaccaccaccctctccccactgggtccgtgcgaggtagtgcagaattcggccccttggggcgccttaccacctctctgcctccgtccccgacttccaccccagaccgtcggagggctccgcccagagtctggtaagaggtttggggaagacaggcccctgggaagcagccggctttggggggtggggagagaaggggaggggctcgggcagagggaactgtgcagtccccaggccgccccggctccgggccagaggcaataaataaacccgatcctgccgggcacagccgcgcccgcgcctccggcgccgtccccgggctgacgggggagggagcggagaagcgagcgcagattctgcgtataaatcagctctggagcagacacagcccggctgtgaaaagcaaaaa

SEQ ID NO: 125 - DNA, 3886 bp, Homo sapiens
  nbla22355
acaggaaggaaccagctgattccatatgcttctgtctgtcttctcgtcgcagggtagattctctgtccctttctctgctgctcttcctcctggagccgtggaggcagctgggcgtgggtgccttccccgtggaaagccgctggcagggagtctacagccccttccgggactttgtgtgtgctggctgccccagggacctgcaggaggccctgctgggcttcgacgtgcagagctccagggagctgcgtaggtctcaggattacctgtcctgcgagaggacccaccctgaggacagtgtgggcagtatggaagacatcctggaggagctgctgcagcaccgggagcccaaggccctgcagctgtacctcaggaaggctctgagcaactcactgcaccccctgggaaagctgctccggacactgatgctgaccttccaggctacctacgcaggtgtcggggccaacaagcacctgcaggagctggcccaggaggaggtgaagcagcatgcccaggaactctgggctgcctacaggggtctgctgcgagttgccttagagcgcaagggccaggccctggaggaggatgaagacacagagacaaggtgactggcgcaggtctccttggggcctgccgtgtccagggaggcctcatgcgtctgctcctaggacctcccttggggaaagaggtgcttctggggaagtgctgggcattcactctattgaccaaacattgtgcattgatcgtttgtggattagaatgacccatgacctctgttctgtgaggaaccagggagggggcactgctacaatgcattgaatgcatctttgttctaaatgtatgatcccaatctcatctttcgcatgcagaaggtgagtagctccccgaggcaccctcctctccctgcacacagatggggaaaccgagggctggtagggatgagcctgaggttatacaggagttaggtgggcatgaaatttgtttcccccagtccctggagcaaaccttacaatttgcctttagattctagacctgaaagtgttcctgatcagagaggccttcctgtcactgccttgcaggaggcaagggaaatggggttagacattagggaggattccccgcccggagtcctagcacagcaaaccaggaggtggaactgaatcagcctggaatggctgctgagagctcagctgcaagttgctggtccatctggggccctggttttgctttcagtcaaatggggatccaactcctgccccacctgccatcttggttgtcaaagtcaaaggagggaatgaagttatgaattgaattgggcaaatgatgactgagaacaggcttggaaaaggttttctggggaggaggaggctggaggccaggacactgtttgttgtggaactaggagctctttgagacgagactccaagtagtaatcccagaccccaccttgctcatcccaacctgttccggtctccccatcagggacctccaggtgcatggattggtgctgcccctcatgctgcccagcttctactcagagctcttcacgctctacctgctgcttcatgagcgggaggacagcttctacagccagggcattgccaacttgagcctctttcctgatacccaactgctcgagttcctggatgtgcagaagcacttgtggcccctcaaggacctcacgctgacgagcaatcagaggtactccctggtcagggacaagtgtttcctgtcagccaccgagtgcctgcagaagatcatgaccacggtggacccacgggagaagctggaggtgctggagaggacatacggggaaattgagggcaccgtgtcgagggtattgggccgggagtacaagctgcccatggacgacctgctgccacttctcatctacgtggtgtcgcgcgcccgaattcagcacctgggagccgagatccacctgatccgtgacatgatggaccccaaccacacaggaggcctgtatgacttcctgctcacagccctggagtcctgttacgagcacatccagaaagaagacatgaggctgcaccgcttacctggccactggcactccagggagctctggtagcctggcctttcctggacagactgaagagctgagcagggcactgccagcctgtccctcattacccaaggcaaggggcaggacaggccctcagaagcagctcttggaggagatgagcattttgttttgcacaggaagatgctgctgctgccctgactgggatgagggtgaggggtgacgggtgtggccctggatgtggtggttttcccttggccactagcccatcttcaatgaccccttaatctgcagcagctcacaggctgggggtgaggagtccctggcttctcttagcctgagcctttctcccaagttccagagcctctccgggcctcagtgctgccatctgtacaatggtggagtgagtacgctgtaaaggaccttccattcattttgctgaattccagagtccttttggaaaactgactttagtctgctgggctgtattgacctctggcaggctcgaagcctcactgggtatgcagtcaacaggatgggcctggagatccgtgaactgcaggccacgtacccatgacgtaaacggcggcactggagcaagctggggcggggggtgggtaaaccctcactgccagcaggccccaagtggcttgtaaatcattctcctgtgacgtctgtgggcctgcgtggggacaacaggggcacatgacatctacctgggccctgaccaataaaccctcagacccaggacccaggaccctgctgtagttggggagcaggagtacctttgggaggggaggactttatttaaacagtggttctagtgtgggaccaagagaggcaggagctgggtcttggggcagctttattcctgttgggcctcagtttctcttccccacacagtttatcttccgtcacattgtgccgggtgacgtgcacggtctccctctgccctagcaggagatgcatgatgacaggcagtgtgatgtgttctgaaagtgtccagggcaaagcgtagggagagggtggatttgtgcagggtgcagctctggagaagaagctggatcactcttggtcccattccctaggccctgagcaagtcaggctcctggctctgggtgtggctcccccaaacgaagtactgacttcagcctgtgaggggagggttgagggaggctctggaaagcccagccacacctgagtccctggcagtagccttggggcagagggcacccgcagagtcccagagatgatgtgggcagtgggcagagagagccttggcgcctctgtttgccaccacttccccaggaaggagggacagcatttctctggctggttccactaaatgtgccagcccaaatgcagggcatgggctctggttctgccgggagcctgtgacacccccaggaagggggtggaactgaggaagagcgaggatatgcaggcactcatgcttaccgggactggggcagctcactaggattctatcctttccaatcggcatcagccagctcttgtcccctgataagtgaggacagcctgaccctggcctcaaatgcagccatccctgagttcatgcgatgctgacgggaccccagcacacttccctgcctcctttgagatctgcgagcccttgctgcagttcagattcaacaaggccctctgcccaccctctcactaggcctcacccaacaccagtggaactggagcctctggctgggcacagtggctcactttgggaggctgaggcaggaaggctgctggaaactgagagttcaagaccagcctgggcaacatagtgagaccctgtctctacaaatacaaaataaaataattagctgggaaaaa

SEQ ID NO: 126 - DNA, 2024 bp, Homo sapiens
  nbla22832
agcgcgggcacacggcggccagagcgccgaggcggtaccttcagcctgcaatgagaggaacccgggagagcccccgggagccagcgaagagcttggctgctgcgtccagggctgctgctgccgccgcggctgcttgaaactcctcaaagttgagagccggctagagggtgccgcccgccgggagccggagggaaaggaagtcggaaggtgcaagagtgacagacacggacagacggacgcgcagaccttcggaaggcactgcgtaggcagcctccccggagcccacgaggctccccagcaccgttcactggtgggaggctgagccggtggaaaagacaccgggaagagactcagaggcgaccataatgtcgttacgtgtacacactctgcccaccctgcttggagccgtcgtcagaccgggctgcagggagctgctgtgtttgctgatgatcacagtgactgtgggccctggtgcctctggggtgtgccccaccgcttgcatctgtgccactgacatcgtcagctgcaccaacaaaaacctgtccaaggtgcctgggaaccttttcagactgattaagagactggacctgagttataacagaattgggcttctggattctgagtggattccagtatcgtttgcaaagctgaacaccctaattcttcgtcataacaacatcaccagcatttccacgggcagtttttccacaactccaaatttgaagtgtcttgacttatcgtccaataagctgaagacggtgaaaaatgctgtattccaagagttgaaggttctggaagtgcttctgctttacaacaatcacatatcctatctcgatccttcagcgtttggagggctctcccagttgcagaaactctacttaagtggaaattttctcacacagtttccgatggatttgtatgttggaaggttcaagctggcagaactgatgtttttagatgtttcttataaccgaattccttccatgccaatgcaccacataaatttagtgccaggaaaacagctgagaggcatctaccttcatggaaacccatttgtctgtgactgttccctgtactccttgctggtcttttggtatcgtaggcactttagctcagtgatggattttaagaacgattacacctgtcgcctgtggtctgactccaggcactcgcgtcaggtacttctgctccaggatagctttatgaattgctctgacagcatcatcaatggttcctttcgtgcgcttggctttattcatgaggctcaggtcggggaaagactgatggtccactgtgacagcaagacaggtaatgcaaatacggatttcatctgggtgggtccagataacagactgctagagccggataaagagatggaaaacttttacgtgtttcacaatggaagtctggttatagaaagccctcgttttgaggatgctggagtgtattcttgtatcgcaatgaataagcaacgtctgttaaatgaaactgtggacgtcacaataaatgtgagcaatttcactgtaagcagatcccatgctcatgaggcatttaacacagcttttaccactcttgctgcttgcgtggccagtatcgttttggtacttttgtacctctatctgactccatgcccctgcaagtgtaaaaccaagagacagaaaaatatgctacaccaaagcaatgcccattcatcgattctcagtcctggccccgctagtgatgcctccgctgatgaacggaaggcaggtgcaggtaaaagagtggtgtttttggaacccctgaaggatactgcagcagggcagaacgggaaagtcaggctctttcccagcgaggcagtgatagctgagggcatcctaaagtccacgagggggaaatctgactcagattcagtcaattcagtgttttctgacacaccttttgtggcgtccacttaatttgtgcctatatttgtatgatgtcataatttaatctgttcatatttaactttgtgtgtggtctgcaaaataaacagcaggacagaaaaa

SEQ ID NO: 127 - DNA, 2106 bp, Homo sapiens
  nbla23755
tttctctgatcaaaattgtggctgttttccttatgaaccataatataatcatttgtgtgatgtacattgtgccatttttgatgactaaatgtctatatttctgccattcctgtaagagagggagttttttactgatagtagcaaatgttcacttcagtcaaacttgggtgttcagtggtaaaccatatagtatttagactggtaaaaatagtttgcacacaggaatagcctctgatttttagctctcttgtaatccaagtatcattgttcatggaattctctaggtcatttttattgtgttgttctaacaagacagattattgctacaacaatagttacaagatatttctaaaatatcctttgatttttactctaagtatggtagagtaagaggctaaacaagaagctgtttccttgaagacattgctttcagtcaccatacatgtctaaataatttagcttatcattcattctatgtaggaatgagataagaaaggatatgatggcaggaaaagaaatgctattcattttttatactttagttttattttcttaggatctatatcctatatatatatattttttaaagcactaatttattgcagtctttattttagaaaaatgtgaagcatttttttctcccctaaaatgaatatatttagatgacaagtctttagtgctggtagaggaactaattgattttgtactatagtaggaaagtgtttatatgtttcaccagaaataaaatatgtagggtttgtatgtaatcttctgtgtttatcctatgttgatttaccttaaatttgcaacatacatatccacataaatattcatgactttcttatatttcattaaaatgttttatggcttcttaaaatcatcactgtgcttctaaatatttttacgtaaaatcattgtataatgctatactgtgatatacatgaaagtttatcttgaacagtgctctttaacaatattaaatttaaatttatcttggttttgctatgcttatgggtaattcatagaaaacagaaaaaatactgttcccaaaaggcagttatatatttcagtttaatatcacctataagtatgagaaaggtttccatgtctcctacccctcactgcacttaggaaaattcttatttatgaataaagtaagataagtaaatctaattgcctagtcgtttttttaacacatatacatgcaatgtatctggatgaatagaaggctgaattgaagctttctttatatttaagaggtaaaaagaaatattaatacttttaaaatatactaacaaccaaaaagtgttcagaattttgctataataataatttgtattaaaatagtacctagaaaaattcagtctatggaataggtaaaattttaaaattttaatttgctctcagagttctgtctgataaaataattgaactataattggcatgatgaatattcccaggttttacttcagtatataaatttaactctcagccacatgggctttccagacttttcaatacatatgatgttgcaggaattgcaatatttgcaaacatgtgccacaacagtgttcttggtgatgtttctaaaacagtttttattctattaatgttaaattttctaacataaacatttaattgattaatgtaaaattttaggaaggaacatctttaattttcaatatgagatggttgcaacctttaaagtagtacatatttgattttttttaaaaggcaatatttttttttctaggaaaactattcattatggttatttaactgcatgttttttaaatttttccctcttggaacaacatgtactggggcctatcaaagggtggagggtgggaggagggagaggaacaggaaaaataactaatgggtactaggcttaatacctgggtgatgaaataatctgtataataaatccccatgacacaaaagtttacctgtgtaacaaacctgcatatgtacccctaaacttaaattcttccctctttttgtcttgggcacaagtttttgggatatggaaaagtttattgtatcccttttgaattttcttctaagatgaactttttaaataaaagatattactgcttttaaaaa

SEQ ID NO: 128 - DNA, 2147 bp, Homo sapiens
  nbla24549
aagtcacgggtgtggaatttggagcaattatacccatcatcttctagaagactcccatatcaaggggcttctggtgacctataagagttcccctttctttctgtcacctcatgtaatgttctcacgcgggtggggctttcagtttttcaaaaggcatcttacatatgtgaatcatagagcagaccctgccagtagtgggctgttgcctcctggaaactgaaggctgtgaatgccaattttcagcctcctggagacctggcagttttgggggaagaccccagggtagacaccagtgttcctctaagtgtgcccacccgtggactggggcttggggcctggggctggggctatgtctgagtgaggctgccacacatccacagccaggcctaccttttgggcagtgctgggactgtcgatgggaccagtatgtcccggggcctgccacatctccgtctcagggccctctccagctctggatttatcccaaaccccatggagcccaggtgagccctcagtaactaccaatagaagattcgatttgacggttggtggcgtagggctaaattagtcactgcccccattaaaaatacagcggggggtttaagagcttttcacgccatgtgggaatcagcagcgaagccggctgatgccttgggtaaggagagaggcggcctaggggaccgtgaggtaatgaggtttatggcggtgacaaggcagccagggaaccccaccgactcccccctcaccccggccgcattgttctccggctggctctgtccctgctgctacggctgagagcccctcgtgactttgtgtggggagggggctggcagtggggaccctgaggcccttcctgggactggcattctttaccatcaggtggtattagggttggggagcagtgtagggttataaacctgtgcctcggagaactcactaaccccttccagaggaaaggtctggagctgggatgagacacttgcctttcaactgtgaggggccttagagggtctctgggaggcttgtatgaagtgatgcctgacaaagggctgcacacagagacctgtaagcagcatggtcatcaatgatggtgccaggcatcctgcaggagggcaccttttcagccaggagggcgcgatggaatcagcctctcatttggatttggctttggggagtgggcgaggtgactgaaagcctaaggttcattgctgctgtatttagatgtacaaattgtcagtttctagcggctctctgggcagaggaattttgcccaggctgggaaatggaccaggaccaggacaggccacaggcccctgtcatggaacacctgcccagagtgcccagaagcaggcaggtaagggtttcagtctcagtggagaaactgtcatgggagaaatcttctcgagttccccagccttaaagaacgctccttttaaattcacagttgtgtaatattgaacttttcacctgtttttcttccctcctaaggtgtgtgttcctagggatggaacctgtacctataaatattcagtaaataggaccaaaactcaaatccatcccttcctctactcatccattcagcaagtatttactgagctgcccccaggtgccaggcactgcacagggcactggggataaggagatgaccagcagatgtggtccctggcctcatggaggccacagtggcacaggcaagcatgccagtaaatgcatagccacacctggtcatgagtgccgtgatggcaaagccagaagctgccagggattaatggagggacccgtgtatgagacacaggggtgcattaaggaaggccttgctgaggcaggggcttgagacctgaagaaataagggaggtgggcagtccaagagcagtgggaagagaacactgcaaatgcagaagccgtgagctggaaacgagccagaagtacccttagagagctgtattcctatggagtttcaattctaggtggcttaaaacaatcccagagaagttcagaatcttgtccaagatcataccattcaggatagacttgcgactataacttgggtgcctcaccttccagcctggggtgtctgactccattgttaattttattataacaatcatgatgacaacgatgaataaagtgaaattgtactgtaaaaa

SEQ ID NO: 129 - DNA, 2353 bp, Homo sapiens
  nbla20084
aagcagagtgaggactccctggccagtgttctctaccatctcttctgcctaccttcttttctctcatggaagtaagaaaagaatccatttcatcaaaggttgaacattccacttcatccctgaattctctcttgctttgagttcttaggtacatctatattagatatcactttctcctctgcatccccaatgcccttttccctcctcagcatacctgatcctctgtccttgctgacctttgtatgtgtgtgttttctcccttgatgacatatccctcttcagctattgctctatttatattcagaatcccaggcaagcaacataaatagatgtctccaaggagtaagtgatttaattagcttgaagtattatatatattttcacacacacagacataaacatatatatgtatgtatgcatataaaacaaataagataaataactggaaaatatatgcaatgaagtcagtgaattagcagatgagataaacatcccagattggtatggtattgtacggtacggtgtggtatggtatggtttggtaccacaaggtctagtgtttagagctggctctgccagtcactatccctttgatactgatcaaatcatacaaaatcagtttcttcatccataataaagccttcccttgttactcagagttgctgttccagtcaaaaataaaatgttaatttatgatacagaccttgataagctgtatgaaccttacatgatactaatgtagtaagatgcaccacggttcattcagataagtgtcccagtgagtcctcagttttcacaaagtcatttcctatccccagttttgtttatttgtgcacctctgcatttacctagaacaagaattgttatattctaagtaattgccaagaagtatggtaacaaattcactactacttgattcttcagtggagaaaattatatacatatatatatatatagatgcttgcctaaatgatatgccattcttccatacttttaaatactgtaacttgtgttattgaattaagccagccagtcaaaagcttgaaattaaacatagtattttcctatgaaatatattttttaacattataaaataaaatttggaataaaagcattatgtatatatatatatatatatatacatatatatatatactcataactcttcattcatttttgtgaatcagtctcattcgtagttttattgtacttccaaatcttcatttttctttggatcattttcctttgccagcattacgtgtgtgtatgtgtgtgtatgtgtgttttaaaagggccataagaggaaaacagcaagaagtctgtctcctaactttgaaacctaaattttagttttctttcacacaggaagtcatcttgtggatctaataatattatgaagttattctctttttgatggacatttaggaatgttttgatgtttcgtacaataattcaagttgcaagaaataagcacacacattttgcaagtacatctatgggatatgttctaaaaaattaaagtgcattctttgtcccttaacctatgatacgggcattctttattttgatagatgctgcagaattgtcttctaataagtcataggaatttacgttttcagttaaaatgtataacagttcttgttatataaaatgtataacagaaaggacttttgatttctatccatctgaatgatgaaaaatagtaagttatttattaaattattattaccttcacatatgtatagtggaacactgagcatatgtttaaaagctacttgagtttttaaaatctgtaatctgtgctttactcattttctttattggctgttggttattttttactgatttttgatgcccctatcttgttaagaaaataatatttttataatatatcacatttatcacaagttactgtttatctttgagttttcttattgaattttgacatacacaaatggctcatatttactctttttatcagcagtgtctttgttagttcctggatttgggatatgcttagaaaagtttatcctaaacaaagacttgtgtacttttaatttattgtcatgtttaaatcgttgctaaatctggaatttattctggagtaagaagtgaagtagagttctaactttactttgattttgttttgttcttattgttgtttttcttccagatttgttatctagttgtataaaaaccaatgattaaaaaaaaaagttttttcttgctgggcaaggtggcttacgactgtaatcccagcactttttgggaggccggggcaggtggatcacttgaggtcaggagttcaagacaagcctggccaataggtgaaaccccatctctactttaaaaa

SEQ ID NO: 130 - DNA, 2194 bp, Homo sapiens
  nbla21081
aaatttctcaacaccacagtcagctaagtcacctactgccaccttcgaaaaacacggagagcacctacccagaggagaaggtagatttggagtaagccgccgtcgacataattcctctgatggtttttttaacaatggtcccctacgaactgcaggagattcttggcaccagccctccctgttccgccatgattctgtggactctggtgtctctaagggagcatatgctggaatcacagggaacccatctggttggcatagctcttcccgaggtcatgatggcatgagccaacgtagtggaggtggcacagggaaccatcgccattggaatggcagcttccactcccggaaagggtgtgcttttcaggaaaagccacctatggagattagggaagaaaagaaagaagacaaggtggaaaagttgcagtttgaagaggaggactttccttccttgaatccagaagctggcaaacagcatcagccatgcagacctattgggacaccttctggagtatgggaaaacccgcctagtgccaagcaaccctccaagatgctagttatcaaaaaagtttccaaagaggatcctgctgctgccttctctgctgcattcacctcaccaggatctcaccatgcaaatgggaacaaattgtcatccgtggttccaagtgtctataagaacctggttcctaagcctgtaccacctccttccaagcctaatgcatggaaagctaacaggatggagcacaagtcaggatccctttcctctagccgggagtctgcttttaccagtccaatctctgttaccaaaccagtggtactggctagtggtgcagctctgagttctcccaaagaggagcaacctgtttgtggtatttgcccagagtccctccagcaccacccctccaattgagatcagctcctctcgtctgaccaagttgacccgccgaaccaccgacaggaagagtgagttcctgaaaactctgaaggatgaccggaatggagacttctcagagaatagagactgtgacaagctggaagatttggaggacaacagcacacctgaaccaaaggaaaatggggaggaaggctgtcatcaaaatggtcttgccctccctgtagtggaagaaggggaggttctctcacactctctagaagcagagcacaggttattgaaagctatgggttggcaggaatatcctgaaaatgatgagaattgccttcccctcacagaggatgagctcaaagagttccacatgaagacagagcagctgagaagaaatggctttggaaagaatggcttcttgcagagccgcagttccagtctgttctccccttggagaagcacttgcaaagcagagtttgaggactcagacaccgaaaccagtagcagtgaaacatcagatgacgatgcctggaagtaggcatataaatgctcacagttaaatctgacccagtaaactctgtgtgtttagggagtatacaaaagaaatcgttcttttccttttcttatgttgttgaatacttcattcacaagggaaataatcatatcccaaagagagagcaattggcttgttttgcttttgttattgttcttccctgttatctgctttatagagagaagtttgtgtggtgggacagattttttaaacacactcacacacacacacacatacacacccagtatatatggggcgatgcacaggtaggagctggcagtgcagggaagaggagacactggtctgcagcaacagcttctactaccagcccttggggcactcacccctgtgatcaagcaatcattgtcaatgacaaagtgactattgaagttataattgtattaaattaatgctaataatttggatattttattttatttttggctgctcgggtaactttagcccttaaccaagcatatgtgggtttttttggttgtttttttttgttttttttttctttttcctttttgggtacagctgtaaaatatttggatataggaaatgttgtgttattcttgcagccttgatattcagggtggattgtaaaatataaatttttgtgagatttcaaagattaagattattttgataacattatttacagattttaaaagatgtggttatcacaagtctcgagggggaaactactgcataaaataactaacttggaataaatattttgcatcagtttggaaaaa

SEQ ID NO: 131 - DNA, 4042 bp, Homo sapiens
  nbla21420
cgaacttgggatccgtctcctctttcgcctcctccactttgggagccccgggctactctttcacagcccctgttgccctgtgatctgtaggtccttggggacgcatagttaaggtgccaggacatcctggaagctgggaaatggtgagtatacggagttcggcatcccgagaggggagagcaggctgtgaaaccggcaggaccggcctccccacggttagctccgagtctcccgcagcttggccctcagtcccctgtggctgcaagatggccgctgggccagcagcgaggacccccacgtcccgtccggcccatccggtcctgtccctgggcagcgccctgctctgcgcccacagccatgagtatttcccagattgttcagggaggcctggtgggtcatcagggaaaaaccgcgactgggtgtttgcgtgggaggagctgcggcccgtggggtccccagtctctcttgttaaaaattaacgggagtctatgttaaacgttaaccagtttatctgaacaaacagtgattggtgaaatggaaagcacccagccatgatttctggtccaccagaggggcataaaggaaaggctttcataagatgcatgagaaagcagcccaaattcaaaaattggttccagttatgtagtcaccttatttgaactatccagatggaaatgtcctggttacatattcagaggttaattgcatgtttgccattggttaaacgtgcattttgtttcaggctaagataatggtttataggaaatgtatttgagttaggttttagttttttttttttttaacctatgaacccaggacactagagccactttagtctaattttctgctctttaattattttaacactccagaggaggactggttttctcctgtgtttttttaatatatggcaagtggaacctctaatcgaccaccctgtttttcagcctaactcaggcttgtggtaaaattatcagttcccactttctttgctgcattctcaaatgcaacacaggagaacagttttcccttgcaaattcacaaagctgttaactatttgtcctttattatacatttcattaaagttttctattattggatttctttctacttctccctacagttctgcccatatttgctttttatatttagaagcctcccttttgggtgcataaatatatatagctatattcacttgacaaattaacctctattattattgtatggtaaactcatttcatgcttgtgagagacattgctagaaagtctattttgtctaatttaagcataactaccattgaactcttttggctattatttgcatggaatatcattttctatcctttcactattagcctatgctcttaattcataattgagtctcttgtaagcagcatattacgaggtttaaaagtttcatttatccactctgtctgctttagtctcttttggctgttagaatatcacagactagtaattaataaggaacagaattttatttgactcatgattctggaggctgggaaggtaaaagaacatgttactggtatctgttgaaggtctagttgctggataataacatggccaaagatgtgagggagagagagcttttttttttttaatatataacagatccattcttgttaaaattagcccattcccataataagaacattaatccattcatgagggcagagtgcttatagcttaattaatttttaaaggttccacctcttaattctatcacattggtcattttatcctaaattttggagatgacattcagtctacagaagtatctgtttagtagataatttaatctttttatttgtaaggtagtgataggtaagcagttactattgtacatttgtagttttctgtccattttaagtttgcttcttttttttctggttctgtctttcctgtggtattgttcatttttgttgagacaaagttatgctttcttgctcagactgaagttcagtggcatatcacagctcactgtagcctcaatctcctgggctcaagcaatcctccccccttagccacccaagtagcttggactacttggacacgtaccacaacacccaaggagcttatgattcttccaccttggcctccaaaagtgttggaattataagcaggagccactgtatccaatgtgtaatttttgttgtttgtgtatgctttaattactttctctttttctttactatgttttttttttccccagtggttatcatgagacttatgtaaaacctcttgtattttaatagtctagtttaagatgataacaatttagagtattctgaatttcagtatgtatttaccatttttagtgacatttatactttagtatttttcatattgttagttagcttttcgtcatatcaatgtgaagatttcttccagaccatggctggagaaggaaagaaggtgtgttttgcctgattcagggactatagagagaaccaagttctgcaggcctgtcacctaagtctcagatgagtatgaattctcttgtgtttttcacagatttttgcagtggcaggaccaagttcaaatgagtcatagccaagtctacagtaagatgtggtagtattctgttttgaaccgaggaccatgattggcaagcttgccacttggtcaagtgcttaccctctaaagatgtcttccttggtctttgcctccagctgggtgtcacaaactctgaactggattctaaggctttcatgaatgcacttatgtttcctgtggcagctgcattatgttgtgggggatgtgcatgccgaacctcccattctgtcatcttgcttatgttactctcctttatgtttcactttctcaaatgaatgtcaagctggtgatttttagattcaaaaattctaaaataaattgctcaaatttccacattatgtaagctattaataaaatgtcttgtaggtgctacatatttattaaaatttttggttgtaattttaagctcactgcaggcagaaaggaatcattaacatttatattctttttttttagtctgtatctaaatgatggcatattttaattccagatatttactttatactgcagtaatgctcgtcatattttgcaaaatttatgttgttcttttatttggaaatataaggcttttttagctcctgaaatctatattatagtcatataattttattatgttttgtggtaagaagtgcagcaacatattgagaacataataaaattatcctgtatttttaatgattatttattaaattcctctcattagagcctgttattaatgattgtaatgtattttctgtataattttactgcaatttattaaattctaatgacttaaattgtctgcttttcatgagtgcacacagttgaatgctgtagatatctaaagaattatttttcggccggttgtggtggctcatgcctgtattcccagcaccttgggaggccaaggcgggtggatcacgaggtcaggagatcgagacaaccctgactaacatggtgaaaccccgtctctactaaatatacaaaaaattagccgggcatagtggcaggcgcctgtatccccagctactcaggaggcccaggctggagtgcggtagcacgatcacggctcactgaagcctcaaatccctagccttaagtgatctacctatctcagcctcctgagtagctgggactaccgacctgcaccaccaagcctggctaattttttaaaatttttgtagaggttgaggagggaggggctctgttgcccaggctagtctcgaactcctggactcaagtgatccacctgcctcggcactgggattacaagtgtgagccatcacacccagcttccctgagcctttatacagaactcgcctttgagttaggttctgttgtatattctagttagggcattatattgattttttaaattactatcattctgaattaataacaaattgtggtacattcatacagtggaatagaactcagcaataaaaagtaatgaggggaggtggggatggttaatgggtaccaaaaa

SEQ ID NO: 132 - DNA, 1898 bp, Homo sapiens
  nbla22452
aactataaagtgtggttcctgtatgatacattattacagttgtcttcttccttaaagactcatcttgaatataaagaaaaagacaatgtaagttcagtgcacagcatcgggaacattagacatgctcagcgtatgcccttcctgccaacattgtacctcttcctcctccgggttggatgggcactaactcgtcctcagtcctgcagctagatctgcaactttgcttaatgatgcaggttaaaattgaaatagaattatgtattattatttttcacattcatttttgcctgagacaggaggtggagggtggtaaattaagaaacccgggaagctcagtgcttgagagaacccatagaagctacagtctagcccatttggcttcttactttgttagattagataatcatacctgctgctccaggcgtgactagcccagtgggagtcaggaaggaaattatttccctctgttgataccggtttacaattgccgactgtcgccaagggctttcagttttaatatttcctctttggtcctcagaagtatcaggtattagtctctgccggaagcaaagcattggtcacttccgtcagaggtgaatgtcttggctgtctataattcctcagtcaggtgctttctgggcatgtgtgagcatttgctcagctagcttttattgcttgtatgttatttgcttcaaaaattacaagaggatttgtcgggtctgagcagtgacctatccagtcccctgaaactctatggttcttcgtgtaacccagggatgtcttgtaggaggtatgtttgctgtccacgaaagtaaaaagtagtgatatctctttctctcttttgcttccttcctcctaattccacattctcctatttcttggcttctggcacagtggagataccgctactctacattaggcatggccttaggggatccgaattctcaggtcttcctcaatgagttgctgtgtggtagacagcatctgaagtttgaatggatagagagacctttgtagattgtggccaaatatttacacctggttcatagagtatgtgtttgctgccctgatctcagtgttggtctgggtgttagtgaacctcatgatctttaggaaactatgtgaattaggcttagtccctgaccctgagaagcttatagttagggaaaaagacaaacatataaaggagaaatacacattagaaacatattcttttttttttttgagatggagtctcattccgttgccaggccagagtgcggtggtgcgatcttggctcactgcaacctccgcctccaggattcaagagattctcttgcctcagctgcccgagtagctgggactacaggtgcgtgccgccacgcccagctaatttttgtatttttagtagagacggggtttcaccacattggccagaatggtcttgatctcctgacctcatgatccatccaccttggccctccaaagtgctgggattacaagaaacatattatttatggtacacatttattaatcaccagatatgtttcaggccttacgctgagtgcttgggaaattgagataaattatagtctcagatctcatggggcgtggatgaagagttgggagaaagaaaaaaataggccaggcgtagtggcttatacctgtaatcccagcactttgggaggctgaggcaggcagatcacctgaggtcgggagttcaagaccagactgaccaaaatggagaagcctcatctctgctagaaatacaaaattagccgggcatgcctctagtcccagctactcgggaggctgaggcaggagaattgcttgaacccaggaggcggaggttgcggtgagccgagatcgcaccattgcactccagcctgggcaacaacagcaaaactctgtctcaaaaa

SEQ ID NO: 133 - DNA, 1798 bp, Homo sapiens
  nbla22595
aagtacaaatccatagggcacatgagaactacaatgtctatctacagtaaatacagtttgatgaataaaatgaaaggcaattgacctaaggtgaaaaaaaaaaacaaaaaacaatcaaagcatgggtactatgtgtcatctgtaagagcatttggttaagaataacaaacaaaccagtattatcgttttaatagccgaaattggcaaaatttccagtttttctttcataagaatgttctttgcaagaaaaaattttcatatagtgagagcaaaaatggcaaccatttgcaagtaaatgtcccatgaaattaagtagcagatatcaagctcatgaccttcagatagttacccctaactcaatcacttacatagcaagtgcagataattttcatagctccctattaaaattatatttcaatgcccttacaaattgtgactgtttttaaataaagttgaccaactaaaattttgtatatgacatatgataaattccccttcaagtcaccttacatttacttaattttattaggcagtgtctgtctaccacccaataatacttgaggattctccctccatttgcacagacatcatagctgggaaacagggattcacaagacccaggctgttccctacatatgtttcctcctccgacatcagttcatcagtcaatcaagccatgtgagagtggaggccttgtattccctattattcttgggcactctactccaagtaggaaaaggccaggaggtcctgttaaaggatgcactcagagcccgggctccctaacgtatgagagtgctaaccagcaggtgtagacttttcaggagtgaagaatgaggcaggcattccaaacctggaccttcatcaccttttgtttcatctcaagacaattctgagggactgttttggagcgtgtctggaaggtgaacgttgaagaagagtgtgggctttgatgtgactcagttgagatctttcatggggaggcaggaattcaatgcccagaatctgggctggtgtctttgaggtcagtaggttgcgtctttgtatccaagtccattgttactaggttggaggctggagattctaaatggcttccagaccatctctctgattctctttgggagatggggtctgaaagacaatgtcagtagttttgggaaattctagaaagtgtgcttggaaacgtgggaagagctcttgcctagtgcctaaacgctccatttgcagctctagccaagtagatacttggtaggtatagagccgggtttgcatttatatcagcaaaacctatgtcagaattgaagaagtagtcaggaaaaagtgtcttggtcgcaggccggggaacatcttaaaagcaaacttctagcctgctgactcttggcaatgagtgttggatcctggctaaattgccttgaatgcagcatgaggccaatctatgaatccaacttctcatggagaaatgttaatattttttcagtttgaatcaatcagggtgaaactaccatgctattggtttgcttactttttattatttcatataaaatctaagacaaaatacattaaatgcttattgacatatgtatttattcttcaccgggctgataatatctgcctgattttaaactttcttccattgtgtaggtttcaacttattctattgtaagatactgttaaatctaatagaggcattgtcacttttatgtataattttattttatttcatatatttcctattggctttttacatttaaattatggagcacttcatcatataaaaagcttcaattatatttaaaaa

SEQ ID NO: 134 - DNA, 1528 bp, Homo sapiens
  nbla22676
ctatgtatgtgagtccatgtatgagtgtaccaccccatatctatgagtgtgtgagtatctgtgagtccatgtgtctgtgtttgtgagcgtgtgtttatgagagtctaggtatgtgagggtgggtgtccgagtgcatgtgcataagtgctagagcctctctgtgtgtttgtgtgtgtgtgtgtgtgtgcccgtgtgtgcacgtggggtggtatacacacagggctccagggctggcatcaggggcgaggccagtggtttttggtggttggagtcagtggagtcaggaacaggacagagtcccagagataacaggaaatagaagaattgctgcaatcgaacgtgcaaagctctctcaacttttctgctgacaaaccgcaaactgcccgcgtccacccccactcgtcccccttccttcctgccacagtagaagggtggggctggcgtggctatcctggctgcgcccacgccctcctgctgcccagcaaccgccccgggtgtggattccatcgctccctgggcttccagtccctcccaccagcccctgccccgctgtgcagaatatgctcggacctcctagggccacataaaaccaccccctcagccagaccagttcctggtcatcctggccttagggctgggcactgggtcagcttctgagcaggcaggagctctgctcatgtggacctgacacacattgcatgagcagacgggaggaaaagaagccagttcctgggagggagtgcactggcgaaggagtgtgtggcgtgggcagagagcagaggtcaggggcctccctgagaagggcagtgcgactggcatctgaggggtgaggagaaaggcctggccagagtcccagctttatgaccattgcagggcagcttctgggctgtgcagctcacacacaccttcccctccttcccctccttcccctcctctctgccctggggccagcctccctcctccactcccctgaaatggctcccagccataattagcacaggacagaaacagcaaatgctggtcggtgtggtaggctcacgcctgtaatcccagcactttggaaggccgaggccggtggatcacttgaagtcaggagttcgagaccagcctggccaacatggtgaaatcccatcccactaaaaatacaaaaattagttggatgtggtggtgcgcacctgtaatcccagctgcttgggaggctgaggcaggagaatcgcttgaacccgagaggtggaggttgcagtgagctgagatcatgccactgcactccagcctgggtgacagagcgagactctatctcaaaaaaaaaaaaagtccttagaacaaccaaggcctttctaagagtgtgccctaagcaaggctgtgtgctgaatgctttgaatcatctcatttgatataaacaccctgctaggcacgatggctcatgcctataatcccacactttgggaggccaaggtgggaggacctcctgagaccgggagtttgagaccagcctgggcaacataggaaggtaccatttctacaaaaa

SEQ ID NO: 135 - DNA, 1132 bp, Homo sapiens
  nbla22909
gttgcttataggttttcagagtaaaagcagttatgatctgatttcaaaaataattgttgtaggaataatgacctatctaaacttttatttaaatttctgtttaaacttctatttaaatttgtgataagttcctcatctgaaatgagctgtctttgttgcttttgttctctttttattaactatgctcagactttaaagtatatacaaatcacctgaagatctttttaaaatctagaatctgattcagtaattttggggtggggcctgagatttttcattttttgcaagctcctaggtgatgctaaatgctgtttgttcatggaccatattttgagtacaaaggatctaaaggaagatattttatattgctctaatgtaacatttttaaacataaacaactttagattctgtgaaccttaaagtgatccgcctcaatctaagagaataacaattttgggagacacttataaaaataatgtgatgttagcttaaacattacacggacattacaaccttacaacttaggtgagagaggctttggttatgctgagttgcctatgtgctagtgataacactacccctttcttctaagtaaaatatctcaggatacaagtgaaaaataatagtactgttatcgagttctctttggtggtcaccatgatgtgtgttgaggagcagagtgaacaaaggcaacctgatccctgtctctgtagagcttagtctttattcactgccagtattttatttttgcttcatagctaattgagacacattgatacctgatgattgggaggaactgttctaatgcgatttgtaaaaggagaattcaaattggaagtaccagctaggcacggtggctcacacatataattccagcactttgagaggctgaggtaggaggatcacacttgagcccaggagtttgagaccagcctgggaaacttagggaaacccgatctctattaaaaatttaaaaattagccacgcttggtggcaggcacatatagtcccaggtaacttgagagattgaggtgggatgatcacttgagtctgggaagtcaagactgcagtgagccatgatcatgggactacactgtagcctgggtgacacagcaagactctgtctcaaaaa

SEQ ID NO: 136 - DNA, 2160 bp, Homo sapiens
  nbla24435
aggagaaactgtttttgtacactgtacatccttagtatttttacacgtatatgatagggatgaacatgattttccttcgtacagacagcttaaataaagcactatgtcaatctgctacttctctgtttattgttgttggatgtggttctataatccccccaaattaaatcttctttaatgaaaacatgatttttaatagccccagctggtattaacctaccttgtataaaatgtgacaggaaaatatagaaataattccttgtagctcacacacacacacataggggatcatttttacttcagtgaaatggcagtagcgcggttgtgaaaactttgatgaacggctgcttctgaggggaaacgctgacctctcagcactggatttaggatggatgtactgtgaagccagggatgaaggaggtctcagaccctggggacattcagacccgaatcatctatacaacacacggtttggacccagaatctgaaggaatgtagcttttcattaacgtcttcctgataatgtactgctctgcatatttcctttcttagagtgtatttctaacaacatgtcatggcaaattaacaaacttagacgtgggtgatgtagatgggtaggatggctggactgcagtctgacttcacgttgaatcattctggatggggcctttttctgattttacctcataaagctactattgtagaaacttggctttgctcctgtgacgaagccagacagaggaatggcttttgggaccagagtgagtcaagcatgtatgtgtatgtcacacggccaaatttgagggcattctcacatgtgctcttctctcaaaaccactggggttgacagatccaggaggctaaaaaaaagtgacctctataattctttaaaggtgctatttttagaatattgtataatttattcacagtatatctaaaacagaattaaggacaattaaaatatcttatgtgacagcctttatgtctagcacatttgatgaaataaaaaacttctgaatctgaatagaagttctactgtttcaggcttgaaccttttacatgctcaagagattcaaatggtctctgtgtgtagatcatgccaccgcctccaaagcctaatccacatcacttctgagaggcaaggctgagcatatggtgacatcagctctgtgttgagatggtgatgaggatgatggctcgctggccaggcagggcagccgaaggtcagggacctgtcctaactaactgcagccttgcctttagtgtttgtcattctcagatacaacacggtatgtccagtgtccgtttttattactttaaagcatttgagggcttaattgtgtatagtagaaatactattttagacaaataattatctgtgtacagatatttgatatactctaagtaaattttctaatttcactaagtacgtttttaggctcctctcaaatactgcgtattgaagaaaaaaatctgacaccaccgagccaaagatgcttttttgtctgttttcgttgtttaacagaatggaaagagtaatgcatagtgcttcctggtgtctcctgattgattgattgtgcacaaagtaggacgataaataaataaaatggagtctgatgggacattgattaaaggtgaaggatgattgatatatagatcatgaaaagaaaaatgaatggcaggaaaaaaagtttggtccttaatatactttggcctagttaaaatatgtgcctttttggtgtgttttgttcatcactacaagataaaaaggaaacattacaactcaagtctttaaaaagttcatttattgaaaatcatatgtataacctagcatacgaatgagcagatttaaacacataacttcaagccatttctgaaaacatacaccaggagctctgctcagctagagtcagactccagctccagcccgactgcgtgcggggacagcgcccgcgttgatgaggaccagccccactgcaggctgaggcggtgtcaccctgggaaggtcgtggtgcgttgtggcatattaagtctaaaccagatgaatgtaaatatctctttgtaaatcatttatttcactctgttccatccaggtcagcaatcagattgtggcatgctgggtaactggaaaaaataataaaaagtaagtttcaataaaaa

SEQ ID NO: 137 - DNA, 1766 bp, Homo sapiens
  nbla20146
aaaaaagaaaacagccagtctgaagtatccattactcaagtcccaaggtgacctctctctcctcagatttccttcttggccctgtgccctgcactttcttcactgtgttcaagtgtcatagctatcaggccactatcatggatatcatgtatccttcctggtgctcacacacctgtcaccttgtaaaacacggacattagtgtgaacacaggacagcttcgctctttctcttcctgcctttcctctatcagagaagttgatccattaagtaattatgtttggtctattgtaattacagatgggaccactcaggggcaaaggtctgactcttcctggtaggtgtaacagatagttcacctgtgaacgaacatcagcttacagatgatgaggacttaaggttgcaagaatgaagatttcagactccaagatcccttattctttgggccttgagcaggttagtagtcccctggtgagaagagaacattttgtttgtggggctaatgggcccagaggagggtaagactctgctgtctaagctgaagcctcttcctcgcagcgagggtcttcctaggaacattgatgctgcctcagacatcctcttttctccagagtagggaagactcccactgatctgagaatgagcccagaggcttgttgggggactgttttactctgatactacctggatatctagcttcctttacccctgttctgcttaacagaactgccaagcccagaagtacctttgcactcctggttttcagtggacagaggaagctttagatagagactttagaccctgccctgcagagtcaagacttgaggccattgaagctgcaggaagccctgcccagggatggtcctgccatgaggaggctgcaaccctataagagggctcaagattgtgaattctgctcctgccatgaggagctcagaaggccaggaagccagcaataggggagagaatctgtgtgcttatggacagtccttacctaaagctgtttctgaatgttgcaccctttgagaaatttcttctcagaaccataaattgaaacaaatgaggactgatcttgtatacaaagtgccaactcaagagggaagttggagtatgtctgttgcagagaaccaatatagcagtgcccaggggtagagaccatgtgttccatactcggatatttgggtctttttgagagagctggggaaagtagcagcaactagattaagactgggaggattttgaccaaactaaaggccttttctccttactgcatctgacgtgtgtcttcttgagacaagatagcacccatgaattacatcatgaggtatgtgtgaattcagtttacatgtaagacctgagagttcgaagagggcacattcccaaagacattcccagtcatgaaatgtagaagactggaaaattaagacattatgtaaaggtagatatggcttttagagttacattatgcttggcatgaataaggtgccaggaaaacagtttaaaattatacatcagcatacagactgctgttagaaggtatgggatcatattaagataatctgtcagctactactaggcatttattgttaattgagttacagaaagtcattcaagactgagtttatagaaagcatattgcatctatctctgtgtagaacatttgattcacattgtgaagaatgcagtttaaaatatactgaatgcaatctagatgtattgtacacgaaaggtgaaaaataacaggtgctctttactgtttagataaaaa

SEQ ID NO: 138 - DNA, 2470 bp, Homo sapiens
  nbla20170
agctttaggcacgttttagtgatgtgtaggactttgacctatatttggtgtggcttctatcctatgaaaagggaattgagtgttttgactcgtcgtttcccacctgttgggcctgtctgtaggtataccttctaaaatcaactgacatctccattttgctacagagtagcaaaaatcaacaatttttaagcatactaatggtgtgcatttgatctgaatcttcttgatgctatcatgtttcagctgtgaatatagcctgtcagatgcttagaacaatcagttgaactggtatgagtggctgcattagggctttacaaatcgttaggactgaattttggtgggtttagagagtgcatttttatagctgagttgaatgtgatgagttcactacaggcttttggcaaaggaggggagctgcagtgagtagctcataagattcattttataaatagaaacataaggattttgtataaggcctcacctgtttataatctacctaagattctttttgggaattaaagttagaattataaatggctggttgggtaaaatgtaatactatgggctttctttagatttttcagagtatgtgggtaacattttggtttatattcttcctaaagacagattgttaggtaatgtgtaaaatctaatttgaccttatgttctcacaattaaaggtttatattctagataacaggtagctgatagctcctgggttctcagctggtgtaattaacataattatgaaagccccaactttttctttttttaagttcttagaggtagaacacagaacaatgagccaaaaaccctgtaatttataagattttgaaaaacaaaggataaaagtttagtcatgttgagtagctcaatagtattttgtttaaaagaatgttgaaattgtgtataggaacagttaaaccctgatgcccttttagttttttatttggagtaatactcttagtaactggtctattataaatggaatgagaaaaagtgtaggctgctgtgtttgcatacctgaggggtctgctatttaggcacatatgtttctattgaaaacttctatctccagaattacctaaaactagatgggaatagtgaagtcactcactgctttattgcagttactttagcttcgtgtttcactgttcgggaagtgtctaaaacatggaattacagcaaagtgtctgcacttttcaaagacctaagggaaaagatggactgatgaaggtgggtggggtttgttcatttagtttgcaacaatatagaatagtactgagaacgtaattgtctctggttatatagtgatggctcggaaggtagtgtgcctgtgagaatttggcaacataagtttttttgatcaagttactgtgccggttaagtgactaaatctatagtcttatgctttttctttttgtagtctggtagcattttattaaaactttcaaccttttaagatttctgcaacttagcagatgtgtcttaagatcttgaaaagcacaaggtttcttaagcagcacatgccactaactggtgagtaggtctttgtcacttcattgagtgaattgaatctctggttgggcttgttaggcttacttggaaattaaatttccgttcagacgttgaaagtgagagtttgcaagtttttcagtgggttaatctgatgtgaaatttcttagaactcattttggaatggattttcacatctgcactaattcttaaattttttagcactacagggaagatctgttctttgaaacaggtgtatgagaatggctcaagtgggaacataccacaaggcatgtattaccgtaaactaattttcaaattacccttttttcctttctatgttcccggtacctgtggatcgactcattggtgattgtatcgacgaacgttgactacggaaccttctaaaatatttacttaacacacatggacatcaactacttataatgaactgttaattactgttccaatagcgtactgagcgctttgggcagggaggtgcggggcctgtgggtggacagggtcctagaggaatggggcctggaactccagcaggatatggtagagggagagaagagtacgaaggcccaaacaaaaaaccccgattttagatgtgatatttaggctttcattccagtttgttttgtttttttgtttagataccaatcttttaaattcttgcattttagtaagaaagctatctttttatggatgttagcagtttattgacctaatatttgtaaatggtctgtttgggcaggtaaaattatgtaatgcagtgtttggaacaggagaatttttttttcctttttatttctttattttttcttttttactgtataatgtccctcaagttatggcagtgtaccttgtgccactgaatttccaaagtgtaccaatttttttttttttactgtgcttcaaataaatagaaaaatagttataatattaaaaa

SEQ ID NO: 139 - DNA, 1992 bp, Homo sapiens
  nbla20216
tagttatacaaagtattttcataatattagtctttctttaatctgtgtagaaatacaaaactgtgtgcttcagataagtctcatttccaatttgataacatttatgtgtgtcctataatgtataatttgagtatgtataaggagaatctatgtcctaacaactttgtagaaccctcttaaaataaaatgtaatttgaaatcctcaggttttagcaattcagttacccaatttttcttctcaaaatatgtttggggctatagcggttttcctaaatttcattcccatctctccattagcccagaagttatatttaacaggtaggactgataggcaagttctatgaaccttttttggtgtttctgctcttttggccatgctgtttctatgactcagtttatatttcttagcatggtttatccaaaactaaatgtattaattcattagtagcaaccaattgggatttcagtcttagcttatccatctcctctctcttttttggttgcaatggcaagatttacagcatttaaactttcttgctactaaaccctcctcaccctactcctcgcttctaaaatgattcttttggccaatcactttgttgtcagtatagttaccatcatagaaaataaggatttgatttcagaaagtttagaaatacaaagctcggcttctaggtatgtaaaatttgatgcttcagaccatcagcaagatcaatgaatttgatacattgatcatctcctctgcctgggagcttgggatatatttggtgtgtgctggattggggagaccttctaaacacatttctgtgttcgtgtttttgaatatactatttacgttaaatattttaagcttctagtagtcaagggcttcggtagtgttatacagacttgtttttaaattttatttgcatataatgcaaaaaggaaatgaaagcatttgaacaatgtgaacaattgcctttacttttttttctaaaagaaaataataacaatagtagacttgttcagagagagcatcccattcatctgcgctccagtctcctcatctgaaaatgagggggtaggagtagataacctttgaaaaatctttgagatgaagttcatcagaggcatttggaaagtcagtatcagttttctgttacaaagaaaagccctgtcccacaaatttctgatttctcaatggactgtgaaaggttagagtaaatactgttttcctgaattcccaggggtctagaacagcattaaacgaaatcttccagtgtatctggggcgacattgttttcctcgctctgaaggatttttttctaggtggaatgtagtaatctccagctggatgatcattgactaaattgtaagcccattcaacccagagagaaataagcctccagtgcttttggatatagtaattctaccttgcattgtgtgtgtgtgtgtgttttcatatgtgcactcatatttgtgtattcagagtgagtctaactaaaaatgaaacatctttcatgaccctaaataacacctttaggatcacgcaatctcagctgaggctaaagaatcacaagaagcgagaatatgatgtgtttgccaaattaaagtagttgatcatgactcaactagagaaagataggggaagggtggtggagatgtggctgcaggcattggcaatgacatattcttgaaagccttggacactactttaacaaagttgaggttaggaaagtgaaacgtcattaaagagctcatcaaaacagagatatgattgatttgtttttctctaaaatgacactgcttgaagtatttaaaattatctggaaagagggaagactgaaaagaaggagtcacggtgagtaactgaggtacaaggtgatggcttccaaagttaatgtcagtgtggtaggcaaggaggggatggagtagataaatattaaagagcagaatgtattggtctggttggttgaatatgtgtggtggtggtggtagtaggttggccaaaaa

SEQ ID NO: 140 - DNA, 1603 bp, Homo sapiens
  nbla20657
aagcattctctctgtgcagattgctctgaaaagtcgatttctgtaatatttgcgtgttttcctctaatgctggcctttttgcttcccacagtgttttacgacgacgacttgactgatgctgtgtttaaaacgctctcccgactcgcccacagattgaaaaatgcctgcacagccatactgtcggtggagaagaggtgagctttgcgccacgggaaccgtgctgacgtcccgagtgtcagcggaactctcacctcctaattgtgtccttgttagtgtcattatgattgttactcagtgccacttattgagcacctactatgtgccaggtctgtgctcatcctttgtgtacgttactgcactgaatctgcatcctagccctgtgtgcaggcgctgctgtcccacttgactgatgaagagaggaaggctggaaagcatcaggggccttggccagggcacggctagttagtgatagacaaggacttgaatgcagactgtactggaacctcaactcttggccagcacacactgtcgagagcttctcttcctgaatgttctctctgtggtgccgtctgtctcttcagctcccccaggtctctttctcttgctgaatcggacagctcctcacccaacagcctcacccagacatttccactagaatatcctgaaatgttaggttccatttattgagtgcccaccttgtgatagctacacacattctcctgtaatacttaacagtagtccacagcttttctgaagatcgtttggaatccacagcaaaagctgtaaaacgaaacagacttcttcacccagcaattcagcatctggaaattcacattcagggttgtgtacaaagctgtatgtacttgcatatttattgcagtgttacttataccaataataccgagggcttgctttgaggcacacactgagcaatagcaatgtacagacctcatttggatcctgatttcataaactgtaaaggaaaaacatcaggacagttgggaaaagttgaatactgaatatttgatgttaaagggtgattgttaaactttagttgaagaggtctccatcttcttgagacacacactgacatttccaacttcacagaggaaatgggttggtgtctggcatttgctttttaataactcagtgagggcagggggccccgggaagagccaaggtggcagagtggctggaagtggacagtggctgaagctggtaatgggttcattagacagttttgttttttttgtttttttgaggcagagtcttgccctgtcggcccaggctggagtgtgatggtgcgatctcggctcagcacaagctccacctcccgggttcacaccattctcctgtctcagcctcccaagtagctgggattacaggcatgcgtcaccacacctggctaatttttgtatttttagtagaaacggggtttcaccatgttgtccaggctggtctcaaactcctgacctcaggtgatctgccctcctcggcctcccacagtactgagattacaggtgggagccaccacgcccagcatagactgttcttactcctgttgcatgtctggaatttttcttgataaaaaaatttggaaaaa

SEQ ID NO: 141 - DNA, 2235 bp, Homo sapiens
  nbla20688
aagtggtgcacatgtatttgttaaataaggtcacccatgctttgtctttagattccccaggcaggattctgtacctttttaaaaaaatatatttaattttatttacttatttatttatttatttatttacttatttatttgacagagtctcgctttgccacccagtctggagtgcagcggtgcaatcccagctcactgcaacctccgccttctgggctcaagcagttctcctgccttagcctcctgagtggctgcgactgcaggctcgtgccaccgcgcccagctaattttgtaatttttgtagggacgggatttccccatgttgcccaggacggtctccagctcctgagctcaggtgacccgcctgcctcggcctcccaaagttctgggattactggcctgagccaccgtccctggccttcagtcagggttctgtctgttgactctccaacctcgaaagcagcagcggtattgtttctgagaaagtttgtttgcattgcttaggaaccgtaacaagcctctcttcataaggataggaagaagcccaagggcattagtgggaggcggataagggagcctaacttcccagtttggctatcattctttgcaaaatcacttctaatctccaaagaggagggggtttctcctctttcaagttgcttagaagggcacccacagatctgcttatttctcacagcatctctctgcccttgcaatctttcctctccacctcaccatccacttttagtgcaattagtgaattcttttctgtttttcacacaatccccttttgtcttatgttgggaggttgctgaaatccctttagaaacaggtcactgttattctgacaggtggccagccttaagcctgccttcatctccatcatttaagtaaataaataccgtgacctaggtcttaagtagggagaaacggaagctgggaggatttgggatttgtcaattgcagataaaacacttgctgtgtctcagaataatgccccattccccactctcatccagcaaggatgtgcagctttggcagaatcaacatccagatattattttgcttcctagtctcttttcatgctctattcccactttcctgaaagttttaagatgctttctgtgtaattattaaacaaaagtgaattaagatctacttttaaggatttggccatgaggtgaggcatttggaaacactgctaggtatggggcaggaacaattgcttgtggggaaggttccaggatgggatggtcctaatgtgtggtttcacggaaggccccaggaccacttctggatgtcaggttcttagcacaaaacatttttgttgttgtttgcttctgtgtttgtttgtttgttttattttgttttctcctatcttgcattcaatagcaggatgtgtcggccttctagcatggctcttccagaagtttagagctacttttccctcccttttctaagtgtcccctctaccttcctcctcttactttgcttttccatgggagagaaaaacactgattcagaaaactccctaagaagctccaatcttccctggtgccccagtaaagtcagcctctggagatcaggagaggttcagagaggatcagtggtatcaccatggtcacagagcaattcaaagataatgccccactttggcatttggacattccattttgagcatgaactgatttttcagcttgacattcagaaataatcaaagatggagagatcagttttggcctgacatagtgtgattttgtagcacaggaccagctgccaatctgtgaagagaaaacaagattatttgaaagaaacctcagaatctgaggtttcccatgaatgttcccatgaggattcattttccttttcttcaacccgtccacctgcaacaattccaataggcttccaattcctccttctacaagagagatgggtgctcagtttctaccttttctacctcagaacatgatggctgtttgtcatgcgttttgacatacatgtgtatgtcaggtctggaagctgttgggtgttggtaagagcccccaactttggaatcagacatgctgggtagccttggatgtgctcttttatttctctcagcctcagattccacacttgtagaaaaggaatcattcccatctcacagtggatttgtcagaattgatacattaatatcgacaggaccctgggtggaggatttttattctgtcaattgtaatttcctaaagagaaaaa

SEQ ID NO: 142 - DNA, 1952 bp, Homo sapiens
  nbla20755
tttgaaacccagtgaactgcaggagtatggctttggaaaatcttggaatctaatttgctttgtaaaatagggaatatttcatttgtgtcttcaggcaagaggttaatagttgatttcttgtgatctttgtcagttctgagctgttgagtagtttagaaatgaagcttaaactagacctgatagcctactacagtgttaaaatacatatgaaaagtcaagcatagagtctaatgaatattcctgcctcttacaaaggtagaaatgatactgcctatggtatttttttttgtttgagtgcaaatccaattcatgaatttgtgcattttagttgaccagtgtttaatatttaggaatagttagtacctaattcatgatgacctcttgttctagcatattgaaggccagctatcattaaagcagtgcttttcacagaatggttttgctgacctcctaaatagaagtgtggatggcagaagcatcaaagaggatgatcacaagtggggaaggcagaaattttaaaagaactgactgaagtaactcctctactaatgtgacaccatctctatcccccacaaacccttggaaatactagttttgggagaagagaggagtatggtgactagaaagtagctataacctgttgatcattgtatactttataaggcagtgagtcagaagatatgtttaagaaatggaaggttgttggagtagctctgatgacagatgcttatcataaggcaaacttaatatatgttccacagtgttcagaataccacttggtcggtggacttttaaatgtgtgcatacttaatttttaataaaccgtagacatggtatatttaaacatactgtttcatttaagactaacttttaagaaatttgctatcacgtggttcacatatgatgtacaagtgtatagttgcatgagataaagctggaagatgacatgaaaaatttaattgtggtagtctcagagtaagagtaattggggagctttaaattttaattttgtctgtgttttcagatttaagtattaatgtaattgcacaaattacaaatgtttaaaaagtgaagtgaatttatacaatctagaagtggtttgtttctttctggaatgagcaaaataaaattagctatcgcctgcagcattgggaatctaagtgttgacatctaaggtgagtgatataacaatgctgggcgcagggtgaaatggtagataaaccaaaatgctaacatttttcttgaaagtgacttgagtttcatgatagttccagaagaggataacaaattcccatttcataacaagtaaattaaaatatttccttatgaacttgcaacttagtggttgcagttacatactaatctctttcctgctttcatttcctgttagaataccagagtaaaagtggtctgattctagtcacttttgaaaagcaaagagttgtaggttacagctgaattttgaggctttacagtaagagaaacagagtgagtctgacaaattttaagctcatatattttccttttagaaatgtaggaactctgcacaaataatgtagaaacaaattaccaatttcaatacaaaaaattttgcaggatagtggaatttgtaagcttgtcataccttgattttttgaattcaccttttcccaaaagaaagcaactgttggccaggcacagtggctcatgcctgtaatcctaacactttgggaggctgaggtgggcggatcatgaggtcaggagatcgagaccaacctggccaacatggtgaaaccccgtctctactaaaaatacaaaaattagctgggcctggtggcacatgcctgtaattccagctacttgggaggctgaggcagaagaatcgcttgaaccagggagtcggaggttgcagtgagccgagatcatgctgctgtactccagcctagcgacagagcgagactccgtctcaaaaa

SEQ ID NO: 143 - DNA, 1605 bp, Homo sapiens
  nbla21013
aaatccagtactcggttacaccagaagactctgatctttgcccccgaaaactgtcctactttatccttatacctgaaatcactgcatacctgaaatcactgcagccctactgttttacccataccattaatttaaaaaggcatctatttctttatagaaagaaacattcacagtgaggtcttagtttgtgaacctcaaaatccagatattaatccactttagttattactttgtaattgcttctcagtcattggctgataatgcaatggtgtgataaatttgacttatctccacatacaaaagtcgatcagaagggatagttctcttcctttttttcccctcctactggctcttactgttttctaatctccagtgtaaatggaatgaacacatctatagttaaggtaaatgccaccaatcagaagattgagtgatttactgcttgtaaagcaactgtctttgaatcttatgaaataggtggtgttgctaccacagaagccaaaaaggtcttaaaattggaaatagatgtctttattgtacttcagccaacagcaagccaggggaaggaacatacataaatatgacaggtcatatatgaaatttggctctcctcctatcaaagtagcctaggagcttggaggaagcctaattaactaaaacaggaaaaaagcatactcatctgatgtaaaaactcatcagctgtaaattaccaacattaaaccagaagtcattaccagttaaaatgtgtggttttcatcttattcttaaataggagaggtggacagtagtgtaagtaacattgctttaaagacataaagcttgtcctggtaaacatggtctaaatgagaaatgcctccatcttttcaggtagaaccagatttcaggcatagctcagctacatctgtatttgaaatacaataaaaatatttcttatgtctctgtattctcttttaaaaagaactgctgactggctcctgtctcttcagtaacactgatttttttttaaagaagtgatatgttggactctgttgtagaagaatgagcactagtattcagcaacaagtgcaatttctccatgttatgttgagctctgttggagcctatggtgagtatttgatgtgaaaaccttgctgtgggaattttttattcttccttttccccccacgccagttcgttttggtaagtcttttatttgaacacaagacgcatgcttttttaaacctctagtttttgaagtaactgtagaagagaatctttaaaaaaaaatggagggcagaatgcttgttagcaatctgaaaatcaaagctgaacaagctgcttaaagtttctgattaagaagtttaaaaagaaaaattaattgctactgctttccaggtaattgtattattagtttctgtataaaagaaacattattgctgttgtataaataaaattttcctgtggtacaattaagtattgatttttcagaaactgtccctataaatcttttcacatatttccatgtgctgtccaaaacaaaaattattgaaatgtctaatctgtgagattatatactcctggtaaaatatttttgtatatataaagaaatatttactattggaaaaa

SEQ ID NO: 144 - DNA, 1534 bp, Homo sapiens
  nbla21172
ctataaatatttcaatccttaccttcaaatgtatattattgtgcacttcacggagttagagtgagaatgctatgttcagcagggtgtcttaagttaaacattcagacttagaaaaccgttagtccacatttggcatattcacttagaaaaatacaggataggatgcagcaagtagggcagtgccaggcattccacagggatccttgtagcagttcacgcagcaatacaacttaggtctgagatgtgagatccacatcacgcaagtgcacaagacacctggttttaaaagttttatgacctgttacccacaggcatagcttctaagcttcctgagacatatgcctcttatgtcattgcacttaagatgtagggtctccattggatactttagtttctcccagtgaagacgcaatttaccagtcaaatcatttttaccacaagcaatgttgtaacacagttgacatactagccttatcagggtgccagagaaacaactagaaatttaatgaaaggccaaattcccacacagaaggggaaagttcttattaaacagtttatagtagtccctacaagatttggggctgggggcggggagttcaatgaaatagtaccaaaggtcacatggaagaatgtacttagaaatgaataaacaatcaggaatagagtccagactagatccaagtacctatgaaaacttacatgggctgggcgtggtggctcatgcctgtaatcccagcactttgggaggctaacgcaagaggatcacgtgagcccaggagttcaagactagcctggacaacatactgagatccccatctctacaaaaaataaaaaattacctgggtttggtggtgcatacctgtagtcttagctacttaggaggatgaggtgtaagttgagcctgggagatccaggctgcagtgagccatggttgtgccactgtactccagcctagctgacagaatgagaccttgtctcaaaaaaggaaagaaaacatacatacttaaatgataaaggtagcattttatttttatgggaaaatgacagatcagtaaagaatggtatatggctatttggaagaaaatagatttagactcttgcttcatacaatattacaacaatacaaattataggtgggttaatatataaatgtaaaaaaactatatgttatttggcaaccatgataataatagttgataaggcaagactctgattggtactaaaactagtacataaaaatttcaggaataggccaggcgtggtggctcacacctgtaatcccagcactttgggaggccgaggccagtggatcacctgaggtgaggagttcaagaccagcctagccaacatggtgaaaccccgtctctactaaaaataaaaaattagccgggtgtggtggcacacacctatagtcccagctacttgggaggctgaggcaggagaatcgcttgaacctgggaggcggaggttgcagtgagccaagatcgtgccactgcactacaacctgggcaagagtgagactccgtctcaaaaa

SEQ ID NO: 145 - DNA, 3171 bp, Homo sapiens
  nbla21200
gacagagtgcaaacaactaaagtataccacgggagaaggggaaggaagtgctgcattagaagtgcaagcaaactgcaatggaagcaaagaagtgatgaaattctaaagagaacagtcaggactgcaaattcacattgttacaccatgaggaaaacaactggagcaagaaacatcccagagaagtaactagggttagataaaggataatgccatgggctaccaagaagcaacaagacggggatatttttcttcaagcacgccatgtgagtcacagataatagagtcgggacattgggctcagccagtgcaaactcactgctcaacagaacctgtcttttttttttttcctttttctactatttttctttcttgtgttaaggtaaactactaggtactgtttttaatttagtttttaattatgatctaaggatcagtactatggaaacacacataattatataagaaagtattgcacatataaagcattatttattttataatattaaataaatggcaacaatctaatgttcaatagtaggggaaaatttacaaaactttactgtctgtacttaacaggatattctccagctactaatgggtgtttatgcggaattagaacaggaaaaaatgcccatattttaatgttaggtgagaaaactgggatgcaaaatttaccatagagtgtgatcaaaagcaaaaagctagtgcattttttagcaacaaaatgtatcagtggctgtctttgtgtagggggaaagaggaggctagaaaatagtatttgttgagtccaaccaactaatttgttcaatgtttctttctgtcgtaaaggtttttatttgcattttaatatatgttttgaccagatgtggtggctcagggctgtaatcccagcactttgggaggctgaggcaggtggagtacttgaggtcaggagtttgaaaccagcctggccaacgtggtgaaaccccgtctgtactaaaatacaaaaattagctaggtgtagtggcgcatgcctgtaatcccagctacttgggaggctgaagcatgagaatcgcttgaacctgggaggtggaggttgcagtgagccaagatcacgccactgcactccagcctgggccacagagtgagattccgtctcaaaaatatatataagtaagtaaaataaaaatttaaagatgtatatatgtgtatatgcacacagacacacacacacacatatatatgttttgatgagcctctaataaggcacttaagggaagtttaatgatttagttatatggttattttcttggaaaaaaaaatcgaggttcctaatcattaagggatattagttgtcttgaagattgacatatgttaagcacacctggaataacaaacaaatttggctgttaggtataacccaatgagtaaaagacaaggatgtgcattatgacatagccacagtgatcagggaggagctgcccatgcacacaaactcacacattcctgcacacaggcatacctcagtaatgaaaccacgtacccctaaggactgagagccaatccatgggagaggtttttaaacgccaaaacacataaggtgggcagagatccgagactcattttatgtagtatttttcaatcgcggttgagagcattgggtagaaggacacttctagatgaagtcgaaagtggcaacagtatatctagagctgacagctggtgttgtaaaatcttcctgaaacaatgttggcaccgtggctgtgtttctcttgtcttcctgtctgtctctggtccaggttgccctatgctcttccctttatttcttattctttttcctggcctcagtcctaggggaagtgaactgtgtacccaggtgtgtatctggcatttctctagcaggtttttaaataattttatctatcataattattttcatcaggacagaaatctttccatattctttatcaagatactctatcatgaaaattgtcaaatatatgcaaaaacaaagagaatgacccttcatataccattactcagatacactgagtaccaagattttgtcatactcagttcatctgtcgtctccctcttttttgtcaaagtaaaaatctcagatgtgtcatttcacccttatttactttaggttatttctcagaaaaatggagagttctcatataacaatgatgctattatcaagcctaacaatattagtatcatctaatacctaacccataatcaaattaactcaattgtcccaaaacagccttttccaagtaggtttgtgtcaatcaggatcccgacaaagtccacacattacattggttgttatatctcttgagtctttttaatctgtctctgcttcctcactctcccccattaacacattagggaacatgttttgaataatttggaaacatagccatcgagtactcttaggaaagagtaatggggttgaggatggttaatttagcccatcctaacttctgtgagatttttttcagaatattttggatggttctctcacttttgttattaagcatttgggaagaagattctgcagcctactcaggtgagccaatctcatggcattgaacagagaagatatgttttcacgtctctaaccagtgtttttcatagtgtaagtcaggcctttctcctttgatctaagtggaaccaagaggttagatactcccttttctttagttatattatgggcttcatgtaactccaaattgtatttcttcctcagctatttatatatattttttggtggtggttctattgttttacaaatttaagcaagaggttgaatagcagagtgattaagagcaaagactgctggagtcaaatcttgactctgggccgggctcagtggcttatgcctgtaatcccagcacacgcctgtaatcccagcacacgcttgtaatccagcactttggggagccaaggtgggaagattgccagaagccaggtgtttgagaccagtctgggcaacaaagtgaggcacccatctctgttaaaaatttaaaaattagccaggcacagtgatgtgcacctatagtcccagctactccagaggctgagacagggagatcatttgagcccaggagtttgaggctgcagtgagctgtgatagcaccactgcactccagcctaggcgacggagcaagacactgtctctaaaaa

SEQ ID NO: 146 - DNA, 2002 bp, Homo sapiens
  nbla21255
atgttttggtggattaaaagtggaacagattcaagggtattagctcaattctgagctgttttgagtttcactcagcaaaggtgggtaagaaggaggctacctcctgagctgtatgttaatacttcttatccttatttatccaagttcctgaggtctccaattgtcccagattaggaagggctgcctgtgtttttatgttatttgcagggtggatgaaaaaactaaaaccaaatattttcatgtgagcagggattagaggtacctgggatttagggaaggtgaacgcagtacaagtgaaaatttttccttaaacttcattgcttctagaccagcctgaagcccctgtgtatctgttaatttagtctggtgcttttgttgctcctgatttagggacattagatgagaagcagtaggcctaagaaaggggaggtaggtggcatccatgtgtggtctgtagttcaggacaggaaagggaatatgtttgtgcctgttgagggtcatcagaaaggagacttcaggagagaatttggcttttggggcctctctctggagtgagactattcttcattgatgatggtcagattgtgggtgtctcccctactcccagtggctcctgacactatcaacaatcatgtgaagacttgtcgagaagagcagaagaatctacacttctttgcaccagagtatggagaagtcactaatgtgacaacagcagtggacatctactcctttggcatgtgtgcactggagatggcagtgctggagattcagggcaatggagagtcctcatatgtgccacaggaagccatcagcagtgccatccagcttctagaagacccattacagagggagttcattcaaaagtgcctgcagtctgagcctgctcgcagaccaacagccagagaacttctgttccacccagcattgtttgaagtgccctcgctcaaactccttgcggcccactgcattgtgggacaccaacacatgatcccagagaacgctctagaggagatcaccaaaaacatggatactagtgccgtactggctgaaatccctgcaggaccaggaagagaaccagttcagactttgtactctcagtcaccagctctggaattagataaattccttgaagatgtcaggaatgggatctatcctctgacagcctttgggctgcctcggccccagcagccacagcaggaggaggtgacatcacctgtcgtgcccccctctgtcaagactccgacacctgaaccagctgaggtggagactcgcaaggtggtgctgatgcagtgcaacattgagtcggtggaggagggagtcaaacaccacctgacacttctgctgaagttggaggacaaactgaaccggcacctgagctgtgacctgatgccaaatgagaatatccccgagttggcggctgagctggtgcagctgggcttcattagtgaggctgaccagagccggttgacttctctgctagaagagaccttgaacaagttcaattttgccaggaacagtaccctcaactcagccgctgtcaccgtctcctcttagagctcactcgggccaggccctgatctgcgctgtggctgtccctggacgtgctgcagccctcctgtcccttccccccagtcagtattaccctgtgaagccccttccctcctttattattcaggagggctgggggggctccctggttctgagcatcatcctttcccctcccctctcttcctcccctctgcactttgtttacttgttttgcacagacgtgggcctgggccttctcagcagccgccttctagttgggggctagtcgctgatctgccggctcccgcccagcctgtgtggaaaggaggcccacgggcactaggggagccgaattctacaatcccgctggggcggccggggcgggagagaaaggtggtgctgcagtggtggccctggggggccattcgattcgcctcagttgctgctgtaataaaagtctactttttgctaaaaa

SEQ ID NO: 147 - DNA, 3112 bp, Homo sapiens
  nbla21345
agatttttagcaaataccccggctcgcactacccggagatcgtgcgctcgccgtgcaaaccccctctaaactatgaaactgccccgctccagggaaactacgtcgccttcccctcggaccctgcttattttcggagcctgctgtgcagcaaacacccggcggccgccgcgggggccacttgcctggagaggtttcatctggtcaacggcttctgcccgcctccgcaccaccaccaccaccaccaccatcaccaccaccaccaccaccaccgggcccagccgccgcagcagagtcaccacccccctcaccaccaccggccgcagccccatctgggcagctttcccgagagctgcagcagcgactccgagtccagctcctactcggaccacgcggccaacgactcggattttggctccagtttgtccagctccagcaattctgtgtcctcagaggaagaggaggaggagggagaggaggaggaggaggaagaggaggaggaggaggaggggggcagcggggcctcggattccagtgaagtcagctcggaggaggaggactcgtccaccgagtcggactccagctccggctccagccaagtgtcagtgcagagcatccgattcaggcgcaccagcttctgcaagcctcccagcgtgcaggcgcaggccaacttcttgtaccatctggcctccgccgccgctgcaaccaaacccgctgctttcgaggatgccggcagacttcccgacctcaagagtagtgtcaaagcggagtcgccggcggagtggaatctgcagagctgggcccccaaagcatctccggtgtactgcccggccagcctggggagttgtttcgctgagataaggaacgatagggtatctgagattacattcccacactctgaaatttccaatgctgtaaagagaaaggcggtagtggcggaagaggttcggcggctgatggcggatcaggatcggaagcctgcgtaactttctcccttgatccgggagtctttccactggattcacaatgacatcctttcaagaagtcccattgcagacttccaactttgcccatgtcatctttcaaaatgtggccaagagttaccttcctaatgcacacctggaatgtcattacaccttaactccatatattcatccacatccaaaagattgggttggtatattcaaggttggatggagtactgctcgtgattattacacgtttttatggtcccctatgcctgaacattatgtggaaggatcaacagtcaattgtgtactagcattccaaggatattaccttccaaatgatgatggagaattttatcagttctgttacgttacccataagggtgaaattcgtggagcaagtacacctttccagtttcgagcttcttctccagttgaagagctgcttactatggaagatgaaggaaattctgacatgttagtggtgaccacaaaagcaggccttcttgagttgaaaattgagaaaaccatgaaagaaaaagaagaactgttaaagttaattgccgttctggaaaaagaaacagcacaacttcgagaacaagttgggagaatggaaagagaacttaaccatgagaaagaaagatgtgaccaactgcaagcagaacaaaagggtcttactgaagtaacacaaagcttaaaaatggaaaatgaagagtttaagaagaggttcagtgatgctacatccaaagcccatcagcttgaggaagatattgtgtcagtaacacataaagcaattgaaaaagaaaccgaattagacagtttaaaggacaaactcaagaaggcacaacatgaaagagaacaacttgaatgtcagttgaagacagagaaggatgaaaaggaactttataaggtacatttgaagaatacagaaatagaaaataccaagcttatgtcagaggtccagactttaaaaaatttagatgggaacaaagaaagcgtgattactcatttcaaagaagagattggcaggctgcagttatgtttggctgaaaaggaaaatctgcaaagaactttcctgcttacaacctcaagtaaagaagatacttgttttttaaaggagcaacttcgtaaagcagaggaacaggttcaggcaactcggcaagaagttgtctttctggctaaagaactcagtgatgctgtcaacgtacgagacagaacgatggcagacctgcatactgcacgcttggaaaacgagaaagtgaaaaagcagttagctgatgcagtggcagaacttaaactaaatgctatgaaaaaagatcaggacaagactgatacactggaacacgaactaagaagagaagttgaagatctgaaactccgtcttcagatggctgcagaccattataaagaaaaatttaaggaatgccaaaggctccaaaaacaaataaacaaactttcagatcaatcagctaataataataatgtcttcacaaagaaaacggggaatcagcagaaagtgaatgatgcttcagtaaacacagacccagccacttctgcctctactgtagatgtaaagccatcaccttctgcagcagaggcagattttgacatagtaacaaaggggcaagtctgtgaaatgaccaaagaaattgctgacaaaacagaaaagtataataaatgtaaacaactcttgcaggatgagaaagcaaaatgcaataaatatgctgatgaacttgcaaaaatggagctgaaatggaaagaacaagtgaaaattgctgaaaatgtaaaacttgaactagctgaagtacaggacaattataaagaagatgagaatgtgcctactgctcctgatcctccaagtcaacatttacgtgggcatgggacaggcttttgctttgattccagctttgatgttcacaagaagtgtcccctctgtgagttaatgtttcctcctaactatgatcagagcaaatttgaagaacatgttgaaagtcactggaaggtgtgcccgatgtgcagcgagcagttccctcctgactatgaccagcaggtgtttgaaaggcatgtgcagacccattttgatcagaatgttctaaattttgactagttactttttattatgagttaatatagtttagcagtaaaaa

SEQ ID NO: 148 - DNA, 1921 bp, Homo sapiens
  nbla21410
atacattttttttttctttaagaaaaggttagctttttatcttgcaggcttttcaccctggttttgataatggtcttcattccttaaaataagtatccctaaacaccaaagggaaggaaataattattgagagtttttagagaccatttttcatttttaaaaatgatatcagagtattgagaatagctagttttcttagatgctgtttagaagatagagatggagaagaatattattccaagcatacattaatgtcaccacatttagtttctttaaatgcctttgtttaaacttctgatgtttgatttaaaaatactttgaaactgctggatgacatataaataacatttcttaatcattacatattctcaaaaattccccaaattagccaactacattagagtgatttttgataagaacatctgaggccaggcgcattggctcattcctgtaatcctagcactttgggaggccgagatggtgtatcgcttgagctcaagagtttgagaccagcctgggcaacatggtgaaaccccatctctacaaaatataaaaaaattagacatagtggcttgtacctgtagtcccagctacttgggaggctgaggcagcccagctacttgagctcaggaggtgaaggttgcagtgtgagattgtgcccctgcacttcagccaaaaaaaaaaacatctgtagtgagcagccaaatgtactataaaatttggtattttatcctacatgatttttctgtcattgaaaaatagtattttgcagtaggatgttcagtgactacttattaaatgtatagaagataacatagctaaggaagaaaactaccatttttggcagggagaagtggaatttaatagaaatcattgattttcatgttaatagtatatacttatgaattataccaagaattgacctatttagagatacttggttgaaatactcaggatttaatgtgtagataagttctttataatgtgagttatttttagtcttggtggttttgttttgttttcagtttttatttattttgatttgggaatgggagctggggacatcaaagccatatagtttagaaaatttcacattactgaaataatctgtatccacaatagtaagcatttcttcttttcttgctgtaatttcatgctccacctacaatatggcttttactatttttttattttttattttttttacccaaggaataaattatcctgacagtctttaattttgggtatggattagttaaatgtaaggattgttgatttgatttagtaatgtgagacacaatgtttatgtcctcattatctacagtagatggatagttttttctcctggtctctaagaatagtatttcttaatgtgtggcccatgattggcattaggcgtttttgcttgaccacttgttaaacatgatttttttctaggtagtgtttgccatttgaatgtctttgtggaaacagactccttaatagcttagctataattttctaagttaacatctttacctgccttgtttttttaattctcctaatcttactaataccttagcattagttttgcttccattatcagtgcttccaacttcttgttttatgtgctttaaaatgattatatatgggctgagcatggtggctcactcctgtaatcccagcactttgggaggctgaggtgggtggatcacttgaggccaggagttccagactagtctagccaacatggggaaaccctgtctctacaaagaatacaaaaaacattagccaggcatggtggtgcatgcctgtagtcccagctacttgggaggctgaggcaggagaatcgcctgaacccagaaggcagaggttgcagtgagccgagatcgcgctactgcacttccagcctgggcgacagagtgagactccctctcaaaaa

SEQ ID NO: 149 - DNA, 2099 bp, Homo sapiens
  nbla21522
tttaaattcagcttgtgactttgcacttcaggattctgagtgttctctgtcttcttcctgcattgtttttcttataccatacaggtttttcattggccttgactttttgttgttaactcattcttctttgggtttattttcatttgtttctgctgaatattatttgtttcaaactaaaaataacattccacattttaattgatgtgcggactcttaatctacttaaaatgtgggctgaagttccatgattccagctagtctggaataggtcatttaactggatgttaattcacctacattgttccctaagtgacatgtgggtcccattctgctgacatatttgtgggtcctggtaacaaccatttgggtagatttgctgattcctcttttctccttagtggaagagaaagccaatacccacctcctcttgggcatgtgcttagacgcctgtgctcgctaccttctgttctccaagcagccgtcacaggcacaaaggatgtatgaaaaagctctgcagatttctgaagaaatacaaggagtgacctggctactaccctggatgcacagggccgctttgatgaggcctatatttatatgcaaagggcatcagatctggcaagacagataaatcatcctgagctacacatggtactcagtaatctagctgcagttttgatgcacagagaacgatatacacaagcaaaagagatctaccaggaagcactgaagcaagcaaagctgaaaaaagatgaaatttctgtacaacacatcagggaagagttggctgagctgtcaaagaaaagtagacctttgacaaattctgtcaagctctaaatccatttttgtgtagggagaataatgtctagtaatgtggaagaatagctatcattcctgtctctgtggcacccgatcaatggcttaaatctgtcgtttttgatattcaggtttcctcaatttagccttagtgaaggaggggttgtacacactgccatttttgtattttaaaggaaaaatgactttcattcccaactgattatgacctttcaggatgtcgtcaagtgatgctttcagttgtaacacgtgacttggtgctgtccctgctggtctaagtagaactgtagattcatatgggctggtgttcctgtgcgctgtgggtgtggtgattcagcctggcatttctaccataagtttttggtctgctgatttgctgccctgtcttctcttactttactttatcaatacctggcaaactgaccagaattaccttcctcatggcaaagggggattatggtgaattgttgttcttatagtctgtttcatgaagcacaagtggaatttaatacataaaagagaaaaatatcttagtttgctaccagcatccagcatgaagttgtaaagtggggattaggcacgtgacagtatagcacccatttgaatttaaataaaagtgaaccatatttatctggttatataaaactaaaaatgggggtgtttatataaaactaaaaactaagaatgatgtaaccttttgtctgtgttatctgaacactctacttcctttgcagccttagtcacacaactgagtcatctcaagtactctttaaggacacacagcccaggctgttctgagtcagaataggcccctacaggtatattttaaaactcttcgtaattctaatgtgtactgctggtatagctgaactactgacctggatcttagtcctagcctttttgcttttgcaatttcagtatcttcatctctaaactagggaaacactgggattctttcttagctgtgggggaaggtatttggttagatgactttgaatgaatagactgctgtgctgaaagagctttatcacactgtctcaaagtatgtaaagatacataggtggatgctcttactgcagcagtcatgaatacatttttagccatttacctaaggaaaaagacagtttttctaggtaccatgaaggaagattgaccctgttggtatgcctgtgggggtgggatgtgagtgggactgataaactgatacttttggttcgtatgtacatactggaagaatcttcataataaatgagactacacaacaaaaa

SEQ ID NO: 150 - DNA, 2471 bp, Homo sapiens
  nbla21631
gaacggccctgcggggctggccggacggctgcaagaacatgctgagcccaaagatcaggcaggccaggaggggtaagtccaactttctggggtttctctgggcaccgcatgtgcctcttggcaaacgtgcgcggacacttggccagccgtcacgccatgtgtcacatggggcgggcgttctgggaccattgccgctgaatagtgagcatcctcctgaggaagtgcccttcctcgtgaaactcctgggctgggtggggacacgacctgaagttgcaaaagggcggtggccggcttagtgccccagtgggtgtgcacacttcgccccacattccacattttacagaggccctcggtcgctccaggtgacctggtggcaactttaaggaaactttgcttctttactaaaaaggaaatgcccaagatttgccctgtggccaacacagaagcaccccttaccagggaaggccatgccctggcttctagagacagctgggtgcaagcgagggtcttcgttcccgctgctttgcagacagtatttcctcaagcaggccaggggcaggcaggctttcctgccagaacactcagaaagctgcagggtctgggggcaggacgggtggatgcgggagcagactcagaccagcaagagatgggggtcaggagagtccaggactgggctagccagcctgtgtccagccagcgacccagcacagtgacctgaagacttggccactgtatggggctagagacagcatctccatggacaacaacttcttagccacggaaagtgtcattttgaatgagaacatctgtcttttacaaaaatagaatgtgtcttttcaggtggccagtatctgggagggctgagctccttttgtaaacaatgaagtggaggatgggtctttggaggtggatggagcatttgcctgggagcttggaaacagtttgtgtctcaccaggtgtttgcagcggggggcctccagcctcctgtggattcacagggaacacacccatcttattagcacactgcaagcacttggatgattttcctggatgggaccagccttccagtgtgttccacagacgtcaggacccctctgtggggtgctttcgcatgggctgaaccctgtgtaccccaatgggcaaaggaggaacttgcatggctctgctgaggagggggcaagtctagtgatgacccaagggataggacaagccagatacctctgcgagagcttagttccaccctcccactcctgtgtaatgagctggccactggccacatgtggctactaagcacttggcatgtcactagtccaaattgagaaaaagacacaccaaattttgatgatttagtacaaaaaaagaatgtacaatatctcaataattattttactgaaatgacagtattttggatatattgggttaaataaaatctattattaaaactaattttacctgttttacattcttttactatagctactagaacatttacaagtacatatgtgactcacattatattttttatatttctattggacagtgctagtaagagaccagtgcttcagcaaaggggcttacaggcagcctgtctttgaaatccaggatttctcataaatgtttgttttaagtcaatggttctcaaccaggagcaatttgccccactagagaacatttggcattgtttggagtatttttggttattccaactgaggggtgctactggcatctagtgcgtataggccagccatacagccctcttccagtcctcagtgttccatgaggcttccaccatagggcttttgcacatcgttctttcccctgaaatgcctcccacattcacatgtgcgcacatgcatgcctgtatgtgtgtgcacatgcgttcatgcatgcaaacatacacacacaccttaattcctattcaccctccagttatagtatagttcaagtgttgccagccagggaagtcttcccacacaccccagtccaggctggatcctctgctccatctctccttttctttatggtatttaccataggttgcagttgtatactcctgagtgtgactgattggtgaatatctgtcacttgcattgctccatgagcttcgtgaaagcaggaaccatttctgttcggggacatcattatacccccaatgccaggtacctggtggacactcaacctgtgttttttgagtgagtggatgaatagctggatagaggagaaagcatttgcctgggtggctggagcactgtctctacccaagctggcccggtacttaggaaatttggcctcatctttcactgactcatatgttgcaaatattttcccaatttgttgcttgccctttatttttatattagagtgggttttttttctagatttacctgtttttaactcgtatatattttccttttagaatttctgtctttgtttgcaatatttcaaaataaaattgttgatgctattaaaaa

SEQ ID NO: 151 - DNA, 2669 bp, Homo sapiens
  nbla21788
aaagcaaactcctacctaccccggcctcgtggagccttcctgcggtcctgccatttgccccatcctgtagacagggctgcaggaagcagcccagccagcaaccagtgtggagggagagggagtccaaggcccaggccggcccctccccatctggggctgccctgcaaccctcagtggtaacttaggacagctcctatttcccctttggctaaaagggtctacaccagtgtgtcaccactcccaaacagtccccttcctgggcctttgccactttgttgaatgaagacctcacctgcagttaagcaaaatattaacatgtgagatgcctttcaagatgcaaaaggatattttccttctaaaatcacatgggcaggaaggctctgaagatgttagagccccagtggactggagaaagccaggaagaaagcagtgtgggtcctgcagtagcccctgccgcttctcctgcctcctgctctcccaggacgcccggggccgacccgggccgacccttgtcatgctccttccgttcgcctgggcctccatgctttcagctaccttctgcatcttcaggtggagcccagtgacagatactcgcaggaaggagaaagcattcaaatggcttaggttgatggaaagtgacactgattacagccaccatggtagatgcttcacgtgtaccttaccaaggaagggcacccagccacgatcataggcgactctacaaacccagccccttactgaactccaataggccaggctggcttcttccagagtcaggctggcccttggcacagtgcccgtgctatgtatccagaggcctgggcccacatcctgaccctgtttctcccttattggaggccctggcatttccgaacccactcacctctaagaattggattctgtacagttaaaggaacagtgtcccttccccgagaggtggagaaaaggtggccaggagggagagggtcctgggaggagcatttatgcgcgatgctgagagatgggattctacggagggaggcagcattggctctcagctcagcaggggctgtgccccagcccaggacgggtgtcctgctcctgctgtctggcaggcgtctgcccgcacccccacactttgcttttgtcttcagtacaccctgcctgccccagcaggaagagccgaggaagacgactggggttggtcagatggggcctgagcagtccctttgccatgctctagtaccatggccttggataagtccagtctgctctccaagcctcagtttctttctgtgtaatgtgagcagctcctatctgaaaggtttattgggcggatttttgcaggtcatgggtgtgaagcccctagcacagtgctggactgtggtcagaactcagtatcactggcccgcatcttcactgtgagcccaggacaggccacacgtcacacgtcacctcccacaaagcccggcagagggtgcccagggaactcttgttatgcccagagctcagtgacccaggggagcacttcttgctgtccccttcccttgagttctccaaagcaggccatggccatgatcacaggctgaggagccaggccgccaggggccatcctggctctgcctcttccatgggagcactttttcctctgcaaagcggggagcagtcggacacctgccggcgatatgaagtctgagcgagtcaggacagggggaggcccagatcccaggcgaagatcagtgctctgtcccgccttggttgctgggagccctcctgtcccctcttcctcagggactggacccaaaccaggccaggccggaagactagttgtgtgtttcagatgtcacttggagttgtgaagcttttatcaaagctgagacaatccctgttaactaaaatccctaggacaatgaactgttgtcctttattcacttcctaattatagaagtgtcctgccatgtagtaagtactcagtaaatgttagcatggtagcagataaagtagaaaatctcttttcccccatgaccctccttgtgaagaggtttctaaaagccagtggtcccttctccctgagtaaagagggtgtggtaacttccagaaacgtttcttgccctttgaggatatgtggcactgagtagtcaccacacaagctcatcccccggtgcggagatatggctacttcaggaattgggaggaccccgcgctgcgcccggaatgtgctctggcaatggtttgcctttcttttctgtcatttcctttatttttgtgtgtttccattcatctcttgttcctcaaagctgcacacagcccgcccttctgctggccaaggtctggttagcaaagggcctgtctccggcggatctggctttcctcgctgtcagccttcaggtgccctgaaagctggcgaaggtttctgagtcaatgctggggttgagtgggagtttagaacatcactgcggtgccgcagtcactcttggacgtccacgtcctcttggaagtttgaggcaggctcagctcagccgttcgctttggtatcctcataatcaggtagaaagtctgggccggggccaggggcagtggtgcacgcctgtaatcccagcacttttgggaggtcgaggcaggaggattacttgagcttaggggttcgggaccagcttgggcagcatggtgagaccccatctctacaaaaa

SEQ ID NO: 152 - DNA, 1969 bp, Homo sapiens
  nbla21897
gagatttgcaaaggcattttaaagaaacggtgcctagaggctgggcgcagtgtctcacgcctgtaatcccagcactttgggaggccgaggcgggcggatcacaacgtcaggagatcgagaccatcctggctaacacagtgaaaccccatctctactaaaaatacaaaaattagccgggcgtgatggcaggtgccttgagaagtctgaggcctccttgagaatgccttaaggaaaatacggtcagaagggggttgtcaacagtgaagttgggaaaacagccttctggaggtgtggctcggaggcagagcatcgggctgtgctggtcagatgccattccccgttggcgctgtggaccagctttaccagtggggatgccgtgctttccaagagcaagcccttacgaaggtggaggtgggcaggtagggaggagggaagatttaggaaggaagaggagcttcaagaaggcagcctttgtcttctaaccagagccactgagactctaggccatcctctgctgtgccccatggtggctattttgggtacttaccacttcctgtccccctcctggcatctcacaggtattcaggcagctttgcatcctgggcttccgttattcctgctgttgataccacccacgctcactggtgtcagcagccaccgttgtacttgctcatacgctagtgggttagaaatggggagcatctgccgagggatctgtcttgtggcctgacctgggcgttgatggctgtggtcccccagggcttcgtgggtgtcccatctgagaaggctggaagttggccaggggcttcatgggggtcctgcagggacagtcccaaggtgacagctgctgcacctcgagtgcggcctgaactggagaggcacctgcacctctgacatggctttggatgctgcacagcatcgtcacacctgctgtgttctgttggttccaggccagtcgccagagctcgtgcagatttggtgggggcctccctctcaatggcaggtgtccaaagaacctgtggacatggtcatagccaccccagacgttcactcccttccaatccactggtagtttccgcagccttcccccatctgaatgtactgaagaactgacacccaccatctggttttaaaatgtttagaatttgtaataatttacgtattttctagagagtgatgtaacatccataaaaacacagattttctaggaagttactgtgaaatctacaaaagcaataaaacatttcctcccaggtgctgagctgtgaggagagcatcagggtttgggctctgctgcctttccccgaagaactcactcggcaagccgtcagaagataattctgaaacaaatgcctgccactctttgattacaaaaatgacggatgagctgtatcaccatatgcctgagaatcgttgtgtgttaaaggacttggatcgtcttcctactgagacgtggccccagcttctccgtgagctctgcagcacacctgttcccaccctgttctgccccaggattgtgctggaagtgctggttgtgctccgaagcatcagcgaacagtgccgccgtgtgtccagccaggtcaccgttgcctcagagctgagacacaggcagtgggtggaaaggacgctgcggtctcgccagcggcagaactacctgcgtatgtggatatcagactactgtcccctgtgctcagcctgatactgttactcattgcgctggagttggtcaacattcatgctgtttgtgggaagaatgcgcatgagtatcagcagtacctaaagtttgtaaagtcgatcttgcagtacacggagaacctggtggcttacaccagttacgaaaagaacaagtggaatgaaactatcaatcttacacatacagctttgttgaaaatgtggacttttagtgagaagaaacaaatgttaatacatttagccaagaaatccacaagtaaagtactcttatgaaaaa

SEQ ID NO: 153 - DNA, 2573 bp, Homo sapiens
  nbla22116
gatatgctgcttagtttcactaaaagcagaccctatacctagagaagtcactggctttttattggtcattctcaatacagaaatacttaggggagtcttaaccctgccatccccggttgaatctcttggtctttatctaagctacttgcagttaatattcagttaagcaaaggtatggccagtagtgcaagtatctcccagtctctgagctctgaacaagaggactgaaattcagcatttgtaaactgacagtttgatgggcctgggatttgaagtgaactcagcacacaattctgaacgtgtatttgcatgtggactgggaaggaaataaatgggaacttggaaataatggaatatttctcctatgaaagaatttttcgtagaagatttgtttttgatataatctttctgttggttagcttttagtgttttcattccttttctgatccacactcctttaagtgaccaaatgaatataacccaacatgcattgggaatgtgtttaatattaaacaatgtctaactgaatctgcaaatgcgggaactgagatatcacctccatgtgcacacctgtgtgtacgagtattctatacaacttgtagcatttactgccacttaattgggttgaacttgcaagataaacttttggaaactgcttagtgccatcggagtctcctttagaagctgccatcaggcaaatgctatcccataataccagcagtaagcctggcaacatgttcaacagatttagtacccaagaggaaatcaacagcgatagtagagaatgagtcagatgtagtgggataaatactagcctaggaagaaggagccccggagtctaatatgagctttattactaaattgctatgtgacgctaggcaagtcacttaacctctccatggctgtttcctcatctgtaaaataagtgtattggactagatgatccttagggtctttccaaaagtctaacattctatggcattataggttgccttgcaaattcagcctgctatagtgatggcaaatatcacgtttaagtctgagtctcttatgttgcagttaaataaaagaactatgtaagatgatttttaaaattcaagcaaatgggccgggtgcggtggctcatacctgtaatcccagcactttgggaggccaaggcaggcggatcacctgaggtcaggagttcgagaccagcctgaccaacatagagaaaccccatctctactaaaaatacaaaattagccgggtgtggtggcgggcgcctgtaatcccagctacttgggaggctgaggtgggagaatcgcttgaacccaggaggcggaggttgtggtgagctgagatcatgccattgcactccagcctcggcaacaagagtgaaacttcgtctccaaaaaaaaaaactcaagcaaatgaagttcataataataggggatgttgataaaacttgtggcagccttccaattcatttacagttgtttcgttttgtttttgttttaatgtccattttctgttgactgttcccagttttcattttccatacagtctgtatgtaaagtctggttttcattaagctgtggccagtatttgccactacaacagaaacacactgtcacacttgctagaatataactgtacttgggcttctcctttcctgtgaagtagtgctgggctttctagagtttaattctcaagtggcacaagatagcagagcccatgcattttaatggctgagactgctaagagtgaacctaaacacttacaagttgcagagagaaatgaaaaagtaattacatgctattagcattgagaaatgttgacaaattaatttgttgggaaccaaagatagcatttctgatgacaactcccacagtgattggccagttgtatgatgagtacactgctggaaagagggtaaactgggagttagtggatggtcccaatgccctgcctacagcagagtgccaaccagccctgagtgcaaaattcaagttcaatgtgtgtgcttgtgtgtggtgtgctttatggacccgcaaataccatattcattattgatgataagatcttcacagaatcctgtagctactaatgcattgagtttttaatctcagtacatcagccaggaggagccagatcacagggtagtgatgtctactgggattatactcataacatctacacaaaacaagttgagaaggatccacgttttcattgtttatcagaattgtatctcatttggctgagcattacttttgtcagaatgtgttatctgtaaaccatgtgtagtgaaattcttctgtaactttggattaaaggtatttatggtctttttgtttgtttgatttttaagtaagttatttcttttgtagacctgctgatggtatggttccatccttctgacctcagcatccaatctttttaaggatttttgttttcaatattgttattttaaattgtggttgaagcaatagaaaattgaaatatggattgtgcatgactgtgtcttgagtgtaaaaatattgcagtttgaaacttggacctaaagtattgcaaataaaaatgacaaacatcaaaaa

SEQ ID NO: 154 - DNA, 3324 bp, Homo sapiens
  nbla22223
caaacacaggctgaaaacccatgctgctgttatacacaatggcagtattaacaagcattttaaacctttgcacatgatattgaacctgttcagtttacaatgacaatattaatactgtttatagctagaagtttgatttctgaattctttgagattttagcaaaacagtttattatacactgtacatttttttcacagcaattggaaaaaaacaaccacttgcaatcattcaataaccctgaagaatttggttcctgagtgtacaaactcagagcccggaagccaagaagggtccttggcctgcacggtctgtagttgactccaagtctctgtgagcagtgacttgaaccaaacacaccaggaataatccattctttggggcctctttccaactcgaggttgttttctttcaagatactctaatcagccatagaatttagtgtaaatatttttttttccaaatagatatcatattcaaaaaaggcagcattcaaattatatagaatctagtttttaaaatcagcacagatcttcttaaaaactgtgaactatgttttgaaatactcgttactaaagctgtttataaaccacaggtgccataagatccccaaacggactaaagttatctctgctcttccatggtcttgttcctctcgttttggctttaggaagcatgtctttaacagcaccgctcgttcacaagttcccccatcaagttgtttggaggccttcagctttaaatgtacaggcttaaagtgcgcttgcaaacgtttgctctcctttttttctgaatgttgattgccttagctggccacctggtgttctgcatgtagccttctgtggtcatgtgaaaggagacaggctcttctaagttgagttgggatttttgcactcagtgaaaagctgaagtgcaaaagagctatcaaagacaagaggataaaagactgggatagtcttttccaaggaccctctttagagggccctaaagacctcctttgggaattctggggaaaaagaaaaagtaatcttctacttgcttcaagatttgatttttttaaaaaagcctgcgacctattcaatacattatgcttaaattagcagtttctctggaattcctgtctctcctttaaaagaaaggagagaacattttagaacaatagttctcaaagtgtgttccccggacaagcagcatctgcaacacttaggaaggtcttcgaaatactaatttgtaagccccacctcaggcctactgaatcagaagctctgggggttgggtccagaagtctgttttagtcaaccctctaggtgattctgatgctcgctaaaggttgagaactactgctttagaatgaagtcgtataataaagtctctgaaaaggccttattcagaataagcaagaaaggttctgtgattcacttttgcttctggggctggcaaaaaccttctctgaacccacacaccaagttcgtagttggtaggtgcccagccaagtcctgacatcttcatgccccctctgcagagggcggctgtacgatgttcacatgtctgcgtttggtcagacatcatctccttggctgccctttgaaaccaaatcacttgccttggggataaagtgctcaattggcattagtgagaagcccatcctatcccttgacatacttaatcatatatctctccagagaactcacctgacaaatgtctctgagcacaggctgacaccaaagtggcacaactgcacagttctcagatttctttgcacagattgatttttattgcgggttttgttggggtgtcttaatgttcatctcttttccactgcccatcctctgtgaacccatacctctctagatggagcaggtggccactggtgcctcatactcagattgaaaaccactacatcccagctacctataatgctgtcagctcaaaatcatagccaggtagttcttgaactcagaacttaaatcctgcacgtggcactccaccactgactggaccgagctggcatatgttgtttctttgtgtttctacatcaaaatgttcgtctaagatttgaactgttctgctgataaccttccccgttgtcatagctatttcattgccaaccaactccatcacatggttgttgatatcgtcatataaagccattgcaaggactctggaaactgccgccaatgaccaatttctgactaaccagccaccttttctctctcttagctccacgtcagcactgagaccagactcgagcacccctgtcctgtaagcgagacaaaatggcgtgtgttattttggggttttgtgttttttggtgggtttctttccttggctctccagatttacttttggggcctgttctaagtgcaaacccagcaagtttcacttgtcctgtccattagatacaactacatcttgcgggggttgtttctttcttgttccacaatgaattgcacatccatctccatcagagctgatagcctgttaataagcactggtctaacacagccaaccctcctccacagcgccatattaatggaggaggggaggaaggtgaaatctactgcatgggattcaggaaacagttgtggttggtcaggacggaagttggggtaagtttggttggtcagagggagttgtgctggagattgtgaaaaatgggttcttgaatgatctactataaggcagggaaggttcatttgtaagtagtaatgtgaactgaattgcattaagagtgtgtggcctttgttgtgatatactatgtattttcttatatgcatgagccaaactgttgcatcataatttagcactgatgtctgcttttattttgatcatctttgtccacccttattagttcttggctgttaaccgtagatagatcttgtaaatccagcaacctttggttgctgcattccccttggttcgattccacgcaaggagccacaagtgagaactccactgtccttagaagaaagggcatttttacttttgaaccaaaaagagaaaaaaaaatcagaagtgttgcatcttgaggcgaattaactgtaagacatttttaattatgactactgcaatttgacaccatttgaaataatcaattcagagacactaaagatttcacaatattcattggtattgtaaaaaaaaaatactattgtatggatttttgtattgctgttaagtattgttttgtgtgtgtgtgtgtgtgtgtgtgttggaacctcctggggacatgttatattttgaagtgattaaactatttaattgtgtgtctatattttggagtggaataatttcttcattaaaaaatgtttttaaaaacacaaaaa

SEQ ID NO: 155 - DNA, 1618 bp, Homo sapiens
  nbla22344
atacatcattagataataatgtagcaataaattgtagctttcactacatatgaataggcacatgaatatacacttgtattagtaaactctagtaaagatttttactctgcctatacaaattatgaattacatatactttaatttctatcatattttgtttgtatccatttaattttcacatagcttaaacacgaagtgaagagagctgtttaggatctgggaaataataaaaatgaattcttttaaaatttatttctggtgaattcgaaatgcagaacatgtctttcaagagacaactccccctttttctcaaaaatgtcaagatcagactagaaaaattttcatccaaggcaatgtgttatttttattgtctgaaggaacaggggagactttcatggaagagagagcatggtttagtgaaagcccaggctgagagcccttactcctgaacttgaatcccacctttctgctgggctggccctgtgtgcaagtcaaccaggctcagtacctacatctgcaacatggagctaagggtatctgctccttccttgcccattagactgtaaggagggaaacattagtattagctggagagttctttggtttcttagcgaaattggtactaaatgatgcactgtggctttctaagaaaatgctttctatgcagtgtcagcccccaggaccatgcgcaacactgcatgcagcagatagaatgcaacataaaattatatgcataactttattttgaatatcaccctggaaagtattgggttttcattgctgtaaaatcatgttaccaggagtcacttcacaaaatacttgataatagaaggatcacttgcattctaatcaccaaacagtacaatttttttaaaggaagcacaaaaataaaattataacaaatatattggccaaagcagactgatgtagatttggacttatattttaaaatcttaaattattataagaataataagttttactatttggtttaatattttaataaaaataaaaaatgaaaagtttgaccattcaaacatcatttgtaagttaaggattagctataaaagtcagacatagacatttgcaacctgtttttggaagctactatgaattgctgaattgtttttcatttatggcctgaaatttgaaagctaagtactgttatgtgaacagcgaattggaaaagggaataaaatattgtgtactcagtggtgattatgcaccaggcacaccacattccttacctgtttttcatccctacaactgcacaaagtaggtattaatagttccacctcagagatgaggaacctagaattgtacaaaattagaggccaggcacggtggctcacacctgtaatcccagcactttgggaggccgaggtgggcggatcacaaggtcaggagatcgagaccatcctggctaacacggtgaaaccccgtctctactaaaaatacaaaaaataagccgggcgtagtggcggacgcctgtagtcccagctactcgggaggctgaggcaggagaatggcgtgaacccgggaggcggagcttgcagtgagcggagatggcaccaccgcactccagcctgggcgacagagcgagactctgtctcaaaaa

SEQ ID NO: 156 - DNA, 2274 bp, Homo sapiens
  nbla22939
ggacaaaaagtagctattgcaagcaccattctctggtttcctggagatttcacgaggctctgctaggtctagcggaaggccaagcaggctgaccactgacttcttaccttcttggattttatcttttttctttattggatttcatagaatattttattgctcttgttgttttttcaatcccactatttaaagtcactgttcctcagcatggagtatggaggtgtggagggtggaaacatgccagggtgtgccgtttgtacttactttagtgagtaagccatcaaaggtctgggaagccatcaagacctttgaacagaagtgtgactgattcagagcattccttgaaaaagatgagtgtaaggagcaaggaggattgagtagggcacatctcctattctgcatcttttcaccctaacacatccattgaacagatatttaccgagtgcctgcctacgctgggccaagcaatgttgtcaacataggggacagagtctctgccctcataaactgctattgctggtaaaagccactttctgaatcgtatgctggtgaaaattctctgaagaaaaggctgccactgccaacttatctcagggcatttgatggtcctgactggccttttcctacccaaaatgttgagctttggtgtttggtgaatgggggtagcacatggcagagtcacacatgactagttgtatgggagaatgatcaaattccagaaacaagagttgtagtcatcctaatagccaagccactgacaaatgtcaactgagtagaaagtaaccactgaatatcgttttaaaaagattcactgatttatttcatctaatcagaccatggagcctgtttaggtagcagactgaacttcatcagccactacttgttccctttgagtttagaaattaaaaacaactaagccggatattccatactgaagtctgggtttgaagggatgtggccaacttgtctatccttcatgatgcaaaatttgcttttatagcataagcagcctttgaatgaacactatctttaggtttggtgtatccgaacacagtgccttttttagtccggagaccttgctctgttgaacaggagagcactggaggtcaagctagacctggaactaaccctatttctcccattcttcaattctggaggccattcacatttcactctttttcttccttccatacttctcctccatctgtgtctggtttttatttaactgattattgcattatgctctaatgatggttcagatcattttggaagataatgaatgttcccaccacaaagaaacgataaatgattgaaatgatggatatgttaattacccagatctgatcactaaatagtttagagctgggaccaagctgaaatattgagatcaaaaagtgggtaattagctgagactggtttggccagctggcttggccagagaaactgaatacagcaaaggcatccaaaggtccttggatttatagctccatgtgggaagggaagtcaattcctgataaccatgatatgttaatcccactggtaaaaactccagatgacaaaaaataatgcaaagttgggaagaactgaaaaatgtttccaattcatgtttgtagttttttctataactaggagtttcggaagcaggactaagactcctgggaagaagggctggcaaaagggaggtatattttggggacccagatatgcacactgagatttaaagaagaaccccttgcagtataggtatgtgtaacacaaagtcaccaaagaaaaaaatatccatttccaaataaaagcccaatcttagcctggaccaatttggagagagtgagaaaattctttgacttccaaccattgtagaaatctttcctgttagttttgatagtagggtctttcggctatataattccaagcctgatcaactggcattattaagttttctgtcatggctagttcagcaactggagtagatatagatttatatgtggataattagctccagtttgataagtaaacaaagataatgtcatgggctgatggaataactgagttttggaaacttttgctatattgagtttggctatgctggtcataacgcattagagctggcggtgtccacaggagcacagtcactcagggctcgattttcttatgcaaaagacaaacgtgtcaacgggaacagcaattgtgataaggaagtaaaatatgggagggatctgtttcctgttggtgattgctcctacgttacctttagctacctgattaaaagaaaaa

SEQ ID NO: 157 - DNA, 2653 bp, Homo sapiens
  nbla23084
ttgaacataaaggacactcaataatttttttcaaaaattaagaaattgaaagaaagggaaatggcatttttaattaagaaaaaaggcatatcctttaatgcactgtttgctaaagtgtgccccataattttctagaatacttgttcaaaaattcagattcctggatgcctccaggcctgctgaaccaaaatctcctaggcttagtaaccataaatattaacatactctccagggacttgttatgaacactaagtttgaagaccactggttaatatcagtggaaatttcacatctattattcttcctctacatgcatttcatttcatttggtacttcaaagtgtgtacggcaaaacaacatcttaaggcttaagacagattatcatggcactcgatgactaccaaaaagtcacattttattataaatataaccaaaactatttttgaatatgtattattgccataaaatgcactaagctcataaaactattgaagacactacctgtacagaacttagagtcaaggtaaaagaaaagacacaaaaatataaagtgtattgaacaagcaaaatactaaaagatacccgaagtgtcatatggttgcacatatttgccattagccaacctactcattatcctgtctcccaaggacaacaaccttttaaggtaattaaaataattccatatgcagacatggcagggagacaaaaagagaatggggctgtacaatgagaagctgggtgtcacgccactcacattcaataagtagatgtttattggaacaaggttcttattttatttacaaaattctctagcgttgtatacccccttctcctccccagggctaaattttattcacatcttggaatagcctagcaggtgttaccaagcacccacataaaaggaatttttgtctggtcacagtggcttatgcctgtaatcccaacaatttggaaggccaaggcaggaggattgcttgaggccaggagttcaaagccagcctgggcaacatagtgagagcttgcctctacaaaaaaaaaatttgaacaattagctgggcatggtgacacctgtctataatcccagctactcaggtggctgaggtaggaggatcacttgaggccatgagttttatacctgcctgggcaaaatagagagactccaactctacgaaaaaaaaattaatttaaccaggtgcaaaggcacacccctgtagtcctagctactctggaggctgaggcaggaagatagcttgaactcaggagttggagctatgatcacaccactgtatgccagcctgggtgacagaacaaaacaatgtctctaaataataataataataataaaaggaattctaactctatgagatggagggtatttgggggtgaaggaattatagagcactgtggagtggtagccctgggaagccagatggcatgagcaccgaatgccttaggaaaaaggaacaggtcagaagagtgaagttggtcacagaatgaaagtggagaatggtgtcacacacagagcacctaatatgcgattttgtaattcctaaaaatggcccaagtaacactgcaaaaatcactgccatataaaaggccatatataaattgccacataaaaactgatataaactttggttaagtccacaacctttagcttcccctaagtggaacctatgatccctaagctgggttgatgcaagtcctcccaaatgtcagcccacacaagtctcttccctacccacttcttacttcttctttcctcccctagaaagttgcaggccagcaataaagggggaaaggggcaggaactagtgacgttgataggggccgcctctcctgttgagttgtctcaggatctccttattctagaccttgatggcacatcctttgaggatgctgatagcctgctgagcaagataagcagtaacagctaagtggtaagatactcaagagtttctggacatttagctgaggagggaaagaaagcattgaaatactggaaaggaagatctgaggcatttctaggcaaggagaatactgttggcaaaattagaagactgggaaatgcatgaggcacagtgatgcaattgagcagcccagccagctggaggctagagtttgagtttagaaggagagaagagtggaaaaatggtatgggtccagactccaacagccctcaaagagtgattataatttttacaaggaatactaattcttattaatccgttacattgccccatctgcagagatctagacatccttattcttagttctgtattaaaggaaaacaaaaacaattatttttaaatgatacactataataccagaaactctttagataacaactgtgatcactattgacaacaaacttttaataagtatacatttcatgggatttagtggctaggttagaaaaaaagtcaaaatattttgaagtaggcttttggttttgctgatacacttctaaaaactgagctctgatttattataattcaaccattgctcatgataatacataacaagtgacacaatctttataaagataacgtatgaatttaaagaactaagaaaatagctgtttctaaagatctccaattttccaactgatttctgagcaaatattctcctaagaaattctatttcctaaaaa

SEQ ID NO: 158 - DNA, 1909 bp, Homo sapiens
  nbla23103
cacttgttcttgtagaaaagggagaaatctctactcaagttttagaagaagataaaatatgggtaaggtgacagttgttactgccatgcaggaagaaaatattggggcttgatagataagcaaataaacaagatacctttgtgataaaggtctccacttttagcactcttcttagccagtatgaccctcaataattcctttaccatctccaaagcttcaggtacttcagctctcaaaaggaaagtgactggataggttgcacctaaaacacatttgggaaaattaagtgtgatttcctcaaatataaccgtatagcctcctaaaataagactatgctgttaaacctcttcttttagattctttacttacccaacccattattaattagtgcctcatctatcccagacggcttttgcgtttgtttgattgtaagccttcaaagtgtcaggtattataatacccatttgttttaattggttaaagtgataaacatagtgcctgtgcatgtacacattgaaggtatggctgtttgacagaaataatcttcctaccttctccttcccagccctaacttctgaagggtgagagaatgagtgtttaaaaaaattttcttttcagcccaatgttatcttttagcagtctttacatcttcatcacctttatgcatggtaatcagcagaacaggtctccctactgcagcagaactctgcatgaacccagtaatttctcaaatctgataggtacagaaaagtgtgtggcctttcacttcctgtcccttcctccaaccccaaaccatagagaagcatgctttctggtgacattttattcacatagacattctcacagctctttattctgtaagaaagattatgtggagtatgaggagtgttgttccgtgtcattttataactgcctactcgtttgattttgcaaatttggaaataaattatgaacgctcaggaaaatccttctatgagagagttattacttctgtccagttttgaaagtcaggtttgcagctatctgtgctatatcattttaggaaggtgcctgatgtgatcttcacacgtatcacctaggattattcaggaaaggataattcagattgtggagctacaatatggagtttccagtggttcagtatgagtgcagtgagcaagacaatagggaccagaatggggaaggccacttaaaaatccaagttcatggctggccacagtgggtcacaaggtcaggagtttgagaccagcctggccaacacgctgaaaccccatctctaataaaaatacataaattagctaggcgtggtggtgggcacctgtaatgccagctactcgggaggctgaggcaggagaatcgcctgaacccaggaggcagaagttgcagtgagccgagatcgtgccactgcactctagcctgggcgacagagcaagactctgtctcaaaaaaagaaaaaaatccaagttcgttactgacttttattgtactccacgagataaaaaacatagagattcatcagtttagctctacttgctcaataaaccacaactttaactctttatatatatttttctgttgacagaatacaaactggtgacttccaaaattatgggtaccttacttctgaggtttagtcaagagtttgtacagctctaaatccttggatagaaggttttaataaaaatgccaacttttaattaaaaatctctctcttgattcagttatcttgcccaaacttggaaactcttcttactactgtatataataattcctgttaaccagatgttgtttgatagctcagtaataacaaatggagggtacttgtcctaacctgatttacattctttccttttgatgtgtagcatatgtggagcagtcagctaaataaaggtcttatcaataagaaaaa

SEQ ID NO: 159 - DNA, 1989 bp, Homo sapiens
  nbla23234
aatttgatgctggggacattacctgactttgtatattgcattttgatctgcatcatgtttgagaaatatctgcaaatgactctaagggagaggactttgaaggattctatcgaacaaatatgtacatatgtttagtgccgtgctgggcagaggagtgtgggaatgtaccagcgtgtatataagacagtgtgcatcttacctaataatctttatggccagattgagaataaatttttcgaaattttctttcttccgcatttccaactgacccttatttaaaagtcattaatgttgagctctctcatggtatctttatccatttttctaaagctgcggtttctcaggttatcaagtttataacccttgtgagcaagtcacggatggtggaggaagcatgatggagtatctgcatgagacggggggctgagtgtgggaaacttgtgggatcttctcatcctccctttctcagagcacccagagtttgacagcgctttgtgagtgtttatcaagagcctcccaaaagaggccgtggggcgatttgcgaagtgcacaaggcaaaaagtcaatagcctgttttcttgtgctggctgggcttcttgccattaattagttgtgtgatttggggctagtcctttaacccatctgcacttccatctctgtgtgtgtaaaatgaggtgattgtaccaggcgatctctaaacacccttcctgccctgatgttccagaaagcctggttcgggagagagagagacagacacagaaaggcgtgtggcccaatctctgctctcaagtatttcaaccataggagcgattaatattcactacacagattcaaaatcggggctactccagggctggggtgccctcctgtccgtttcttttctcctctaataaactcaaattgcctacaacttttctttttattattattattatactttaagttctagggtacatgtgcacaatgtgcagatttcttacatatgtatacatgtgccatgttggtgtgctgacatgcacacatatgtttattgcggcactattcacaatagcaaagacttggaaccatcccaaatgtctatcaatgcctacaacttttcaacatgattttattcttctcagcattgccttccacacaatgctcttttctatataacttcttcctgtgaggttctgtaatatttgctctgtgcctttcttttctcacattcattatctttcaggtagaaacacccaagagtgtttccacttgaactttcctctttctcaggacagcctctttgccaaacccatcttgacgcatgtactctcttccttgagcgtatgtgcttgcaaacactgtgtatggtagaatcatatgttgccacattgaagacatataagatgcctccagtttctatgttcaccattgtgatcattgatcacatatatgtgcccagttacatactgtactgaaccaaccatcctatgccagacgtttacaaacaaaacattcagaaaacagatggggcatagaggatgataataaggcagagtggatggcaggaatcagcagagtgaataatagggatgtagactagaccaaaggagaaaaaaaatcctgggagttttggttgcaaatttggaatgaagagaatctattctttttttctgtttattgggctttaggactgtgtaaacaaatttaggctggctaggccaggcatagtggctcacagctgtactcccagcaagcactttgggaggctaaggcaggcggaacacttgaggtcgggagtttgaaaccaccctggccaacatggtgaaactccatctctactaaaaataaaaaaattagctgagcaccgtggcacatccctgtaatcccagctactcaggaggctgaggaaagagactcacttgaacccgggaggcggaggttgcagtgagctgagatcattccactgcactccagcctgggtgacagagcaagactctgtctcaggaaaaa

SEQ ID NO: 160 - DNA, 1715 bp, Homo sapiens
  nbla23300
aaatatgtaacaatacgttctgggaattaaatgtgatgttttaaaaaaagcaaacccacactgcattagcccagtgccaagcacataagtgtttaataaagagtaatgatattattaacacacttgaaatgtatcaccccttcagttaatagaatggtaaacatgttaggatgcctgcctagaggatttagcagaaaatgctttgtaaatgttctatatctgaaagtacatgttgatgtccaggttagcaagatgaacaaagatgcgcagatgagagcagcgattaaccaaaagttgatagaaactggagaaagagaacggtaagtaatagattgtgttaataaattacatttcaccgcctttaatagttagcttgtaagaatctaaacaagaaatgaaacatgtcactggaaagaattacaattgagattataaaagtttctattccgaacatctggaaaaaataatttaggtttgttaagtattgcaggacttggagggaagtggtgatgtagaaagatgagcaagatatggctcttaaagagtaatttgatggagaagaaaaagtacatacctgaattacaactggagacataatgttacctgggttttaacagggagacaatgttgtggaaccagcttcatttaccaagctctcaaccttggagcagcaagtgctgtttccactctctaaaacattcttccttctcttcctttttagctaattctagctcaactatcaggtctaatttatatattgtctcttcaaggaatgtttttaagtcccaaataccttgttccatcatagcatttaatcaacattgtgttctaacaatctacttggctagtttgtatcctccagtataatctaagttctttaacaccaaaaacaacattgtatacccagcatctaatgctttgtttggttcataattggccacgtaaatatttgcagaatcaacaggtttagaagtacaaagaaggggctgaggaatcaagaaaggctcccagaggcagggttataaagtgagtaagacaaatatgtataaggaagaggcaaatatgtataaggaagagggggaatctttcaactcaacccgggcattcaggtgatcatgtaagatctcacacaataagaaaaagaggtgcatctgttgctgactttatttttggatgatgggagtcatttaaagttttaagaaaggaaatgactagatcacatttacactttaggaatcttactctgttggtgtggagcttggacttgaaggggacaagatagatggcagaaaaatgaggtagaagattatatagggttgaaaatggaaaactccaaaaattggaaggagaccttagaattttaataaaatgtagaaacagcaaccctcaaaatgaggaaggaggcatcgataactgccttgggtagctttagaggatagtactgctggtaaggagtacggattgtatgttgtttttttttttgttgtttgtttttgattcatgcagcttcaagttactgagtttctatcatatgccatgccctgttaaggtgttggaggtaacagtagtagacaaaaatggagactttgttttcacagagcttgcattctaatgggaggagacagataaaactgtgtaataatgtcagatggtgatgagcactagaggaacaataaagcagaaaataaagaggtgtaatattttagatagaaaaa

SEQ ID NO: 161 - DNA, 2585 bp, Homo sapiens
  nbla23369
atacaaatattccagccccaaatgagaaatcaaacatattaaaattgttcaagaaaatttctttgaacacttttgaaagtttttggaaacttagaaaagagggaaaaaaatccagtgttactagtaatttccatggtaatacagataaaatacattcttttaattctgggaaattagaaaaagtggggtgatctttccaggaaaaacatgtgtaacatctgcttatcactccagctccctcctcctcctcctctccacgttcccttgagtaaatgtctgggaaagcatgaagcttgatgcaagaaccctgttgtactggcgttttcctcccctgtgaaaacgtaactactgttgggagtgaattgaggatgtagaaaggtggtggaaccaaattgtggtcaatggaaataggagaatatggttctcactcttgagaaaaaaacctaagattagcccaggtagttgcctgtaacttcagtttttctgcctgggtttgatatagtttagggttggggttagattaagatctaaattacatcaggacaaagagacagactattaactccacagttaattaaggacgtatgttccatgtttatttgttaaagcagtgtgaatagccttcaagcatgtgaataatcttccatcttccccgccacacatacacacacacactttttgtttctttcaggtagacaccttttaaaatgcaaaactaactgaggcatttcagtaactttgctttcaaatcaataaagtcaaatgtatggaaacattttgtgccctactctccataccccgtgtactcaaattctctactgtatgaattatgctttaagtagaattcagtgccaaggagaacttggtgaaataaattattttaattttttttttatcctttacaaagccatggattttatttggttgatgtgtgctctgtacacaagccatttcaataggatggagctgttaattattttccaaagagtaatagacatgcaaaagtttcaataaaaactgggccattaacaaataaattaataaactaataagcattcccttctaggtttttgccaaactgcctatccaataacaaatttgagaatcgttgaaaaagctagttatatttcagagaaatgattttcattattgaaactgttctccctagcaggccattttccctttttcctgggagtttagcaagtttaggagagaatagtcatgaaaagaaagggaagaaaggggagaagggaagaggttaaaaagtaagtgctcagacctatgaacgtaatccctttgctagaaatatttaagagcagctcagcttggttgaaactgagttttgtcatcttccatatttgcaggaaggtattttctgacttgcaatgcagctagatgtaaaattttattttatcatactagaaagccttgactagaaaaatgaataaatattgagggtttcctgtccatatctggcttgcatgtgccagaaagcagagaatagaaaatgtaatctccaacatccaagcatcgaaacccaaggggtaggcaattctatgtaggttttggacatgaagtttggtgcatcttggtttatgctggctcaactgctattaaacctctctggcttatagtctcttcattctattagacaagcacgtatcgaacacttgcttcgcacaaggctctttagttaacaatttagcagctactgtttgtgttaaacacacttttcaccaaataggttctgaggcaaacgagagcaatgactatttaaagaaaggctttcccagcatcacttacacatcccaaaactaaaaagatcaactcttccaactgagaaaagactcctggctttgaatggaaacttacagcagagagtcacaggccacggcaacaacaacgacaacaacaaacatttggaatattattctcaactcacgttttaataatacatcttattatttttctagtagagaaactacaaatcagcctcttcaacatttatatacagtttaataagcctcttgcaagttacttgttctctcacctgaggtatttttttcctccccaccttgcccctgttcctcccttcctcttctccctttgcaagaggaaatatttaacatatttgggtccaacttcaataatgtaataattaatacattaaaagcatttaacttcctttctagaaaaatgcacaggctaaggcatagacaaaacaaagagaaatgctgagaaatttgccactggagacaagcaatctgaataaatatttgccaaaagttctttttatgtcatatagtgtcaggatttgaaggagctatttttttttaatgttgcaactagcaactcatcttcggaagacacagccaggagaatgaagtagaagtgaaaggtttataaatccatttgtaagcatttatcccatatattttaaattcaagaaaaattgtgtttatctttagaattttgtattcaatactttatgtactatgtgactcatgcttctggataaataaagcaccaaatatgtatctgtaaccacaatcacacatattatattaaatatatatctataaaaa

SEQ ID NO: 162 - DNA, 2027 bp, Homo sapiens
  nbla23436
gacgctacggcggatatggctgcagagcggccggctgggatcttagataggaggggtggatttgcaaggcctagaatagctggggagtggtttccccgcggaatcggcctccctgccgctcctgctttgtactgtgacgctcagcctgtgatgactggtgtggaatccgctgagccaccttggcctaaggagactttaccactctgagattgtaaatctgtaaaatagagatgtaggattagcccatacggtagttgtggtaaatactgtgagacaataaggggcctgggacacagcattcaaatgggaataatgaaggtcaagactgtgattcctgtatctttgacgctctcggtataagcaccgtcgtgggcacagggcagtggcctttatgcaggagtttaagagggaatgaaggaatgaatgggcaaactctggagttcccaagtattctctccaggagctgtttccattcttttcgtttccagcaggttggtaaattcattaatttattcattgatctaattaaaatatactaagtgcccctcacctgtgctaggccaatgtgatacaatgagcagaacagtcatgggccctccctgggaagccctcactagcccaaggactccttgtagacatttaagtgtccacaggctctggagttccaaccttgagtgcaatttagcagctgtggaccttgggcaagtcattacatctaagcctgttttctcttctgcaaaatggttaaggattcaataagataaaactgtaggcaatgaaaaccgtacctggtaacagtaggtgctgaagaagtgttagctattaatttttgcttaatttttctctctctgctctatgtgatgaaaagattcaagaggcaattgttggaatgtaaaaagagcacgggacttggagtcaaatacttaagtctaccatcaagtagttgttaagaattaaacaacaatttttgtgtacccagttaaatgtgggctgcttaggaatgatgactgtgtcttaatgatctctgtattcttagtgacatgtagaatcattgtgcctgacacatagtatgtactcaggaaagaaatggaaaatgtggttttagcattgaaggccgggagagagggtctaacagactacaagccctgccaggagcagagtaagggaaacagaggagaaaagtgtttttagtctgtgcctgaatgtatttacatctgtttgtagcccaaaagccaaaagcgtacatacgcttggcttttctgtagctatgtttatggctttacagcagattttatggagctgcaattactttgatcatgagggactgatgctagtggatttacttcaccaaatggaactcactttgtggcttctgaagaagggacctttgtggactgtcatggagtagttaagagtgcaggctctgatttagtgatcagagtctgcattgtcaggaatgggacaaagtgaagttatgtggcacttgataggatgccctgagaagattgcaacatcacccctgtgatattcctgctgaagatccataacctggatgtaatcatgaggatatatcagacaaacccacgtaaagagacatgctgtatacaaaactgtaatcttagaaagtgccaaggtcatgaaaatcaaagatagaccctggaactgttccaaactggaggggaccaaagaggcatgacaactaaacacaacacatgattctgaactggatctttttgcttgaaaggaagttacagggacagttggaaaagtttaaatggggcctacaatgccgtggtaatgatgtgtccgtgttaatttcctgattttcatggttgcctgttaagttacatcagaggatgttcttgtttgctggaaagtaaatcaatgtatttggcaggggataaggcatcaaatggtcaccttaatttcaaattattacagggaaaatgtttctctctgtacttaataacttttttgcaatttcttaaaatgaaagctctggagtaaaaacttcaaggatccaaaaa

SEQ ID NO: 163 - DNA, 2400 bp, Homo sapiens
  nbla23511
tttcctggctaactccatccagatgaattattcagtattttttctcctatcttaatgaagttaatttgaatgctaatttcctataaccaagaaaacagttgaattaaataacccttatcttttaaacttaaagcttatactactaataatcatttaacattcacttccttttttctgacttaattggtaggtaaataaaatacttcaaatttgattggcaaattggaaaatcacttagaacaatctgctagtattttttattccctttgttttttcctttacacatttgtactgcaaaataaatcaaggacaaagactcacactgaattgatcaacttgtgtttggtcttcatgggaattacatcttttttcccctcaacatttattaaaggaacatacagaatttcagactatagcaaactaatacctttagcttgactaagagttgattttcgttaaggaacagaacttgtaatttatttcgacatactttaatgtatgactcatccctgttaaagttgtgagactcaaaactacgcccaaatcacttaattttatgtccttccctgtttactgtgtctgaccttcaagatttcgtgactgatgctgaaatggaagccaaccactgcagaaatttgggggaaaatgagatctgaagaatacaaggggaagtaggaattcatttctagcatttccaaacctgcttaatcgtgtctgctccaccacagtcagaggaaaagactgagttcatggaaattaccagctaagccttacatctgtctttaatgtttttaggaagtatactgaaaaggtaagtgagatgtctgttttgaagaaagactcttactgggtaccttaaaacccgttgtttcctattagtaaagatgggcagcttctttattcctagcttcaaaaagccttgcccctgtttggtgtgtttctcagtattgtggagaaggtagtttctgagcaaggtggtgcttttcctctgcttctcagcagctaagacagaaattgcaccgaagtgtacaaagggccaatttttgttgtcctgttgtgctcaaatccttttttttaaaaaagttatttcaatcaagtcttagttttattcctcactatataggaaaaaaatctttaatgcctcaaaagttccattcagcattacatttgcattactcttatttgcagcaaatatgagtaaaattataggtttttaaaggtctctaataacatccacttatattggttttgtagataatccataaattaccagaaataaattattccacatttattacacacccatgtaatagatgtcgtgccaggccctggaatatactaatggcatcacctcatgtggtaaaaagacacattccgccatcctggagtatacaaaggtagactagcatatagttcatgtgctcaaggagttcatttttattgacatgatacagatagaattgtagtttagggaatcaaaatctaataaaatgaggctaattccattttcccattaacactaataactagtgtgtaaatctgaatatgacacattctatatgaaagaagctctgtgtgcatctacactaaatactcgtgtgtgccaggtactgttttaaactacgtatatttttttaattctcataactgttctctgaggtatgtactaatactaaagcttattgttaaaggaaggcagaaaaattaagtaacttggcctaagtttgcataactgtgatctgggatcaatatttgaacccatacaggctgattgcagagcctgcactcttaatttgagtgtgatatttatgtgcagtacctggctataagtacccacaaaacgtttcaaattctttataaaatttgcttagttaaaaaagtaccaattgcataatatggttataagtctggtagaagttaggctttttacaagacatgctgcttactgcaccaaggaggcaagaaggctttttagagagcccagaatttcctttcctcaactcctgcttccaagacagtcattttgcatgataaccgtttccccaaaaaacacagacacaaaatttaaagaactggaacagaggaagcagagcttatcatagtatatatgtttagtaccctgtcacttaggtccacccctctttctttgtggattgtggacattttgtttaactgctaaatcatgagaatatatgactgctgagacttttccaaggattttttaaaaaacacattaggctttgtgcagaagtaaagaaaaagtgctgtgagaaccccaggtaggtaatttactttctattgtactcatagtttgtttgaaacctcttcacctctatcccttattgttttatactctgtaaatctgattttacctttaataaacttttctgaagtgaaaaa

SEQ ID NO: 164 - DNA, 2954 bp, Homo sapiens
  nbla23664
cattaatttaatagactttatattaagcagaataaattgtaatattgcttatgactaacttcaaatctaatattttaatttcaactaatcatttaactactgacatcaagaaattactaaagctgttgagatttctatctcatgtcttgatgttctctcagaatgtttattggtctcatgacttttggtgactttcatttctcctgctgtccccatttcttcataaaagctcatgtaaatacctaatatttaactttaaatttcagtaatggcaatcactgtttattttctctgtcagcacaatacaagaagctgatttacagctgtttaaggaaatacaaatgagtggaagaaaaggaaagctttttctgggaattaaagagtaaatcaggttttgttttattttgctttgttttaagagttctatacaatataaatagaaaatgggtgagtccccatagtcacttgtttggctctaaatcttatccattctattattactcctgagaaagctttgtagttgtcatgttactcatgttttaatgactgagaagagttttttcattggtacttttaaaaaatttaaataaatacaaattgatttttgtgtttggtaaactatgttttctagggtggtgtttttaaatgtagtttaatttttaactctgttttaatttgtattctcaaccactagttagcagaaaataaaatatctgtaagtcagataataaaaaacttaaatgaactgtaaaaacctgaagttatgaagaaagagtgacctaatataggtactagtttgtttgttttttcattcattcattctggcccactgtgttcagtcttgtacttgaataaaaatgtcagaaacaccacacttttttctttagtttttcatgcttttttgtcttttcccctcccccagcaaacgtgttattgtgtgtcagcattttctgcaaacttcattttttctactagcatttaaatatttcctgtgtcctagggattgctctgtggattgcaggataaaagagggaagggaccctagtgcccctccaggaggctgtgtatcttgtagtggaggagtccaatcactgaacagatacttacatttagaatgatgagtgctctggtgaaggggtacagagtactacaggacaccagcgtgaagattaaagggaaagtgtttcagactagaatactccctgtctttttctgtataaaatagaaaacattttgctaacattagtaggattatagttacttttcgtatcgttctcttcgaacctgcctaacattgcagagcaagtagggtgagttggaaagatttttcaggttctcatattgactattttgcttttcatttttattcctttctcctaacaacaaaataaaggaattcagacaaacatgtcatgtgataattatatagccttgggtaatacattattattttttagttttaaagtactttaaaaattggcagagtatttttagtatactaagatttgaacagtttaaccagtagtgtcgggatttgattacgctgataaagatatgcaagaaataaagtaataaaagacaaaatgtaggtttggaaaattcaaattgtagttttatccattaatcatatactttactttgtgcttgtcattgtgataattacataaagataaataaaataacacacctagcccttaaagtagtagttctttactttttaaaggtcaggggtcccttgagaatctgaaaaattgagaatctcttcctaagaaagtgcacatacacataaaattttagggaatattctagttgtcttttcatccttgaaaccccaattaaaaattcatgtcttaaagaactgagatgatgatcatgctatatgagctagttaattattaatgctgatgtggatattcgtttaaataaagcgaaattttagaaatcagaagttaaatttatagaaggaaaaagtatattttctgttgttaggaaagcattttccagtaatttgatttttctggcaccctaactaagggaagttggcttttttaaattttactttgttgcagaagattaaatttaaggttgagttccactttgtttgcaatagtttgaaaaagaatagttaatgcagattttttttttaaatttttttccttttaagctttgtgtcttgtacaatgtgagtttgccaaattttcttcatctgctacagattaggtatgccattgttgctgccatgtggcggcgcaccccgtgcttcttaaacgcactgactggaggtttatcgcatcacttgttcacatgcacggagcctggtaacagcctcatctgtatcttgttagcttcattttcttatttttaaaatttcattatttataaactcaacatagcatttaaaaataaaggctagttttaattaattaatgttactacaaaaagtcattgctaaaattttcatagtgaaacagattttaacttttgttaaaatgtgctatgctttaattaaattgtatttactctacaagcagggatgttttacctgccattttaactgtatttgccaaattctaaatataattttgaaaattgaaattgaagcttatgtttatgtggcaaaagtaagcttcaggactgggctgtgtatttttattggcatgtaacagttaatatgagctctacaagaatttgtttttaaggagctaaagctatcaacagctgcagatttaaaaaattatatattaaaactgttaggttagctcagttgtacaacttagtgaatcttgtatcctgagtttctgaaggctggtggataggtatctctgaaatcattgtgttttagtctttttactgatagttttgtatagggaattcatcttctcttttaaaataacttttttcctttaatttatttctattacttattgtacataaattttaaaataaaaaaaaaa

SEQ ID NO: 165 - DNA, 1996 bp, Homo sapiens
  nbla23860
tatcaaaaagattttatctgtcccaaactttctaactgtagccccagcaccaacctcttctttacatttgcaccattacctctctttgaatactgtccttttttaacttgattctgtttatgatgatgccaaccaataaattcaattaggaatataatgatgagcaaagcagacattgactctgtcctcagtctgggggagaaaatgagacattaattgaataatcacacaaataaatataaatctgttactgtgtcaagctctgtgaaaaaaaaaggggggactgtgatgctctgagtacctataatagggcatctgactttgtcggggtggtcagggaggtcatggaaggctcttatctgaatgaccaatagaccttgactaggcaaagaaaaggtcattatcaatggctgcacaatgattacaaatctgtctgagtgtatgactgagcagagcacagatgagaacaacatgaactcagtagtgctttccatttagaaatttataataaggaggctgactcatggttgactcactgtctcctcctaagaggctgcctgatggggtcttccacttgcttatcagagctctgtggtctcgacatagacatgattttctaaatcccatggctgaccagttctgctgttccttcggttttatgtttatgtgtttgtttgcctatttatctacctgtgtgccagaattatgagatcgttcattgccactgctgcatctttccttctcctctaccggttcctcccttggccccttttattttctgtattttctccctttcccctcccttctctacagaaactttctcctcctcctttctcttagtcttaatttgccattcattttcttttttttctcttttattcttgtcttttttttcttcgctgttcaccatgaagataccaggcttatgtttgcatagtgcaatataatttacaaaggcatctcagggacattattccatttgatcctaatagcagctttgtaaggtggttgggtaagagtcatttatcctgtctacagatatgacagaggaccagtgacttccccaaggtcatgtgtctgggaagggaaggattcttgactgcaacctagatggctgtctcctgcactactagaccatcctgccttaacagaaatgtcacatacattccaatcacgtcttttagtctgactgacaaaagtccttttccgtcttgtctttatctttcatgaaaataagtctagacaaaagtcgtggtcagaggggttttctggtggctcatccatcacatgagtagaaacagccttagtcttatctgatgaatatttgcgggacaataaatttgaccttggattgaactgcttataaataatgattttcattctgttggtaccttgcctggctgtgacctggaaggtggcatggctaacaagaaccaaaaacaaagaggattgcctcaggtatcatttgtcagccttcattatattactcatcttgagacatctatctttatatatccaaatgaaatctggtttttttttctgcatatatttcaatccctcagagactcttaaattccatcaggatttctgtttacttccttcttctgaccaattataagagagtttaaagaaagagcacgtctgtatcctatgccacagaccagatgcccctttattgccagggaaacagccagcgatgtttatcctttatttaatctctctgctgactttcagtgctggtaaatgtttattccaccgaagtatgcttttaagatgtcagtcagcaacctttattgaccaatggatcacatttggtaaaggctcctgcttattacatagagaattagactgctcaaagaggattttgcaggggacaggcaccatttattcattcagtcattgatttgattgattaacttcttatgcatttgttcaactaagcatttactgaatgtctagtatgtgccaagcactctggtgagatatttgagaaaaa

SEQ ID NO: 166 - DNA, 1481 bp, Homo sapiens
  nbla23877
gttcaagaggaaatcttgtgttacttctttatgaaggactccagcctggtggagatgaatgagtcctgaagatggaatcgaagctgtttgggcacaaacaaggtttcactcttgttgcccaggctggagtgcaatggtgtgatctaggctcactgcaacctccacctcccgggttcaagtgattctcctgtctcaggctcccaagtaggtgggattacagtactttaatcagcatttaatgacccagtcgaaaattcattgtttggacccaagcactggtgggaaaggcaggaggggaggcctgccttccttcctccctcccgagccctacagcaggccatggagtggtgagcgagttcgtacagtgccaaccacattcccagaaacttccagcagaggttaatcctgctcctctcaggtgggcttggcccattctctagactttggaaggtaatgttctatagaggcctgttctgaagctttaccaggtcaaaccggagaagaacccaacaagtaactcatcccagcctaactattcttcaagggcaatcaacctacagcatccaagcacagagaaatcaaatccatggagaatcttcaaattaggctcagaatccatttgggtcaatgaatttactgttattaagatcttagttgtgttcaaccatgatttgacataccttagagtgagaagatattcttcctggcctcagactagttgaaggtagagagagagacaggcccttgggtgtggggagacctctcctgggataatacacacaaaaaaccaagagctgctcactgtggtgcaggagacagcagggcctgaagccagaggctctgtgtccttgaatacaatgttttactcctctgacccctgttactgtgatttggagaggcagacaatataggatgggctttgcaggcagggaggtccagttataatcccagctcttactaagttgggtaagactcactctgagacttagtttcttctgtcatctctcaatagaatcataaaggtactttcctcttagtgttgttttaaaattcagtaaaataatgcaggcttagcacagggtctgatgtaaattttcaatgaattatcgttgtcaatattgttctggaaaacaagagggcatattagaagatcaaaagtactgccaagcattgaagtgccaattctagatccagtctcagccctctgagaatggatatcattgttttcaagccattcagaaaccaatgtgaattgaacacctagtatgagctctctgagggaagagccaagtcatgcattttttatcttaaggggtcttcaatacctctagcccaaaacagtatctccatcaggattcttctctgatagtgttcatttcttttttctcaatggatgccttaaaaaaaaaatcctacaaggaaacctgtactcctcaaatacaccactcaggtgaccattaaatcatttacattgttaaaaa

SEQ ID NO: 167 - DNA, 2056 bp, Homo sapiens
  nbla23998
ctttgtgtgtttggcttatttcacttaacataatgttctccaggttcatccatgttattgcaaatgacaggattgcattctttttttatggctgaataatttgtgtatatatagcacattttctttattcatctattgatagatgcttaagttgttttcatagcttggctattgtgaataatgctgcaaataaacatgcaagtgcagatacctgtttgagatatgatttcattttctttggatatatacccagtaatgagattgctgaatctacaaaactttttactgagataatcactagactcattaaaagtaccaaaataaattatgtgcctaaaggaagttatctgtatcctgctgttcatggtagataatatccgtatggccattaaggtctcttttataatttgagcaagcttcagacttcaaagacttcaccaagctacgactttttgctttaatctccatagttcagctatattcactctggctacaaaagtttcatgttcctatttactttgacttttgttggatatgggctttctaaatattttaaagaaaaatattgggactattctttggcactgtaactctgaaacagctgctcccttagcacagaaccatgcacttgtcagacacatggtgaagacttgcagagtgaattgtaaagccctgtattctcgatcgggtaagcacttgggcagcccctcccattttgcagacagagaactagaaaatctaggaaatctgagacgtgcatgtgagaaccaggatcactccacaactgtgctgttgcagcagctgtgatagaaccaggctcagctggttgcctcagtgagccacatctgttttctctgcctcaccacctagcattgcatttcttcagcctgtttttctggtcctcacaaaggggatgtaattgtcacataggatactgtggttcacaaagtccatggagtggccatctgagttaattaaagctctgtggtagttgctgaaagcatttctgcctgaagtgattctgtcctgttgctttctcctgcagggtgtggttggcggtgttatgatagtgactcctaacaacatcatgtttgaccctcataaatctgatcctctggttattgaaaatgggtgtgaggagtatggtctcatctgccccatggaagaggttgtttccattgcgctctacaatgacatttctcacatgaagatcaaagatgccttgccatcgtaagacatttatttgtttaccaggaaaaaaggggtgttgagagagctaaatgtagcttaaaaatgagggcatttgcatgattgagggattgtgtagaggtgattttgaagatggaagacttgtgcactgaagaaaatgagaaaaatgagaagaaatgaaaagaataaaatcaatgatgggaaaagttgaacatataaagattaaaggagaaaaacaaagaagccgtcatgtaaaaatagtatttgttgggcttatttttctaaaaagcagtgcacgttcttaatgaaattatgaaggaagaaaggcagttctctgaaagaagtttatccaattatcaataagagaataatgttttcttctgggtttaattaaggagagttatgtttgtcttcatttaacttctaggaaaagcagtctccctgattcatgtcctccctcagtcctgcatggagagaggtttgggtctacagtgtagtggtagccaccttctcatgctgtgaagagggagtaataccagtttgctttttccctgaaatacagatgaatataacttcagtcctgattacttttgccttataatgctggatttattgtaaaaaagagagggaagctccccaggaaaaaagagaaagcattaagaaagctcaggaaattgattaactgatacagataatctgatttttactgtcctttcgctctactgtgtctgtttctctataaaagccagcagtaaaaaactttaaaaaccttcagtgatgggaagaggcaaagcagtaggtcctaacagtaaagagggaaactagcccttggggcttatatgaaaaa

SEQ ID NO: 168 - DNA, 2564 bp, Homo sapiens
  nbla24043-1
atttcatgactggtgcgttcctaaactctgaaatcagccttgcacaagtacttgagaataaatgagcattttttaaaatgtgtgagcatgtgctttcccagatgctttatgaatgtcttttcacttatatcaaaaccttacagctttgttgcaaccccttcttcctgcgccttattttttcctttcttctccaattgagaaaactaggagaagcatagtatgcaggcaagtctccttctgttagaagactaaacatacgtacccaccatgaatgtatgatacatgaaatttggccttcaattttaatagcagttttattttattttttctcctatgactggagctttgtgttctctttacagttgagtcatggaatgtaggtgtctgcttcacatcttttagtaggtatagcttgtcaaagatggtgatctggaacatgaaaataatttactaatgaaaatatgtttaaatttatactgtgatttgacacttgcatcatgtttagatagcttaagaacaatggaagtcacagtacttagtggatctataaataagaaagtccatagttttgataaatattctctttaattgagatgtacagagagtttcttgctgggtcaataggatagtatcattttggtgaaaaccatgtctctgaaattgatgttttagtttcagtgttccctatccctcattctccatctccttttgaagctcttttgaatgttgaattgttcataagctaaaatccaagaaatttcagctgacaacttcgaaaattataatatggtatattgccctcctggtgtgtggctgcacacattttatcagggaaagttttttgatctaggatttattgctaactaactgaaaagagaagaaaaaatatcttttatttatgattataaaatagctttttcttcgatataacagattttttaagtcattattttgtgccaatcagttttctgaagtttcccttacacaaaaggatagctttattttaaaatctaaagtttcttttaatagttaaaaatgtttcagaagaattataaaactttaaaactgcaagggatgttggagtttagtactactccctcaagatttaaaaagctaaatattttaagactgaacatttatgttaattattaccagtgtgtttgtcatattttccatggatatttgttcattacctttttccattgaaaagttacattaaacttttcatacacttgaattgatgagctacctaatataaaaatgagaaaaccaatatgcattttaaagttttaactttagagtttataaagttcatatataccctagttaaagcacttaagaaaatatggcatgtttgacttttagttcctagagagtttttgtttttgtttttgtttttttttgagacggagtcttgctatgtctcccaggctggagggcagtggcatgatctcggctcactacaacttccacctcccgggttcaagcaattctcctgcctcagcctccagagtagctgagattacaggcgcccaccaccacacccggcagatttttgtatttttggtagagacgcggtttcatcatgtttggccaggctggtctcgaactcctgacctcaggtgatccgcctgccttggcctcccaaagtgttgggattacaggcatgagccactgcgcctggccagctagagagtttttaaagcagagctgagcacacactggatgcgtttgaatgtgtttgtgtagtttgttgtgaaattgttacatttagcaggcagatccagaagcactagtgaactgtcatcttgttggggttggcttaaatttaattgactgtttagattccatttcttaattgattggccagtatgaaaagatgccagtgcaagtaaccatagtatcaaaaaagttaaaaattattcaaagctatagtttatacatcaggtactgccatttactgtaaaccacctgcaagaaagtcaggaacaactaaattcacaagaactgtcctgctaagaagtgtattaaagatttccattttgttttactaattgggaacatcttaatgtttaatatttaaactattggtatcatttttctaatgtataatttgtattactgggatcaagtatgtacagtggtgatgctagtagaagtttaagccttggaaataccactttcatattttcagatgtcatggatttaatgagtaatttatgtttttaaaattcagaatagttaatctctgatctaaaaccatcaatctatgttttttacggtaatcatgtaaatatttcagtaatataaactgtttgaaaaggctgctgcaggtaaactctatactaggatcttggccaaataatttacaattcacagaatattttatttaaggtggtgcttttttttttgtccttaaaacttgatttttcttaactttattcatgatgccaaagtaaatgaggaaaaaaactcaaaaccagttgagtatcattgcagacaaaactaccagtagtccatattgtttaatattaagttgaataaaataaattttatttcaaaaa

SEQ ID NO: 169 - DNA, 1945 bp, Homo sapiens
  nbla24402
agaaacatggatacggtcaacctattaggcctgagccttggaccacaaggcctaacacctacaggtctaaggagatccctggaacaaagacactacacacactctttcaggtacctttgttatgggcacttgaatggtgctgcttcacagaggctgcaccaccagtcatgaggatctcagaccagagctccaggaagttctgctgttggtctgataccaagagtaccttcagattctggaaaggattttcacggggttgcctatgaaggagacaggaaaggaccttagcatgacaagtaatatccaacaaactgcctttctgcaaagggactcatgtacatctgaatgctttcaaaaataaatgccccatcagacatagtgtctcaagcctgtaatcccagcactttgggaggctgtcgtggttggatctcttgggcctgggagttcgagaccagcctgggcaatgtggtgagaccccatctctacaaaagacaacaaaaaaattagctgggtgtggtggcgagtgcctgtagtcccagcagcttgggaggctgaggtagggggatcacttcagcctgggaggttgaggctgcagtaagtcgtcactgcgccactgtactccagcctaggtgacagagcaagacttcatcttaaaaaactaagccctatattagggtcccccttctcttccttctttctatgaatgatctgtattccttgcattcctggctttctaatttccatgtttgttctggggctgagaataatccaaatcatgctcctgagcctatatatttttaatgcttgcttaaaacttagttctctgactttacaggttgagaatattgaacctatatacaaatcttcacacatttgcaaaaggttcctagccaatgtaacctagggaaataaactagataaactcctgaagtcatttcaaacccactcaaatttatcccacagacattccaatttctagaaagctttactctctcacctagattctcttccctccaaagcttgctgtcctcctgcctatacaattctggatgggcttcaaatacttaccagtccagaattctttgctcctcaaggctgtacccagctggcaacagataattacggtagttctggagctggttggcatggcaactatcatggacccagacatgagacacacaaggaatcccactggcaaggcacaggaagtacttccgggttcgacaatgctgatccgcaattagaagacactggtaagctgtgttacactgcaagaaaagaagcagagccaatgggtttggtgacttctgtggaaagctcctaagcagcagccataatgagccatgaagagcagatctgaagactcccaactactacccaaaatgtgatttagtctatcctgcccaaggccactcttctcactggaaggcccaagtaatttccatagatgttctctctgcctcacctgcagcatactgaggacctaaatcctcaacggacaaccaaaacctatgaactcagcctttcaggctaaaaatcagcaaccctaataggggtttctactactaaacataaacatcaatcttcttttgtcccagcaacagaaccatagccattaactaacccaaggtcctaccttctcttccctatacacaacaaaaattctatttcatgcaaaaacattttggcagtttctcagttcctgaaatctctggctactttatccaggttccccaacccctcccaggcctcttctcaacacagcaagttggctcttatcattgccactatattaggttacacaaagaaactcctcacctgggcttcattgaaatcttcaaggatatagccagctcctgctcgaagctgggattctgtatactgcttgttgaaaggaggaatttccaaaaattctatattaaaaaaaaaaccaagataataaaaa

SEQ ID NO: 170 - DNA, 1559 bp, Homo sapiens
  nbla24821
atatttaatgtaattactgatatatgtggttgcattcctcctcttttacctcatttttactctttattttacttgactattgtttgtgcatgcatctgtgtgtgtgtgtgtgtgtgtgtgtgtgtgtgtgtgtacacatgtatttccctaaagtgattggctggtcaaaactgtacagtaccacataccccatccccaaggccccatatttacccatttagcaactttataagatgaaatccttatacttcatttatttctccacgttctctgtttttgccttgtcaggccacaggtctttcctttctgccttctctgatacttcctcaaaacctgtgccaatcatacctgtagctgtggactttgctgagagagtctagtatttttagcacaagctgtaatgagagtgtcattgacagggtgttgcttctctttcagtaatccataccaccagctgtgtgatttgcctgtcatctatcttcacccactcatatgaactcactctcttactgtcctctctctcctcccctttgtctccatttttgcgtttttgtctttagatctctgttctcatttagattttggttataggaccttttcaaatgggttacgtaggttgtatattctttgacacccatcatgacaaaactattaatacctttctttctgaaatgtgagtcatattttgcctagctttctgactcatatcagagttcttttctctccgacatatagaagttattctacagttttctaagttctggttttgcaaatgagaattcaacttactttccattgtaaactttacatttctcattctggaagagcatttgattttcagtttatccttgaaagtaaaaaatttgaaaaggatacgtcttgttgtatgtgtgtgttcctattaatcacactcagtgagccctctaagtctagaggactcaaatctagtgattgtaatatgggagcaaaatgatgtactggcttctccacctgcagcatttattttctatattagtagtattattttatttatgtatattcagaatttataaatttaaaactagtaaaatatttaagaatttcaattacaaacatttaaacctaaatgattaagtatttacaaagataaactttaaacatattattcaaatatgttattagcagattaattaaaataaaatatcaaaataagcattacctaaaatgaaaaaccttaatctggaaaaaaaggtaaagtaatactattttttctttttaaaaaggtataattaggccgggcacagtagctcacgcctgtaatcccagcactttgggaggccaaggcgggcggatcacctgaggttgggagttcgagaccagcctgatgaacatggagaaaccccgcctctactaaaaaatacaaaattagttgggcgtggtggcaggcacctgtaatcccagctactcgggaggctgaggcaggagaatcccttgagcctaggaggcggaggttgcggtgagccaagatcgcgccattgcactctagcctgggcaaaaagagcaaaactccatctcaaaaa

SEQ ID NO: 171 - DNA, 3106 bp, Homo sapiens
  nbla20026
ttttcttgtacattttgcctcacctacctcaaggctagagcagttttgccagctctgtgtgcttcaccccagctgcttgcagccagtgagagaagctttccattcttcctggaccttctgggcttggggaagctgtggggccatctatggctccttaggccacctgttccacatgcatgtctttagcatcaaatgtgctggttgtgggaggaccatgggaccttactggcttcctacactgcttggagaacagaaggtgcaagtgatccctgttttcaggttcattaaacctattgtggggttcttctgttcccctcccagggatgagtgatgaggactcagggctccttcccacagatgcttgtcccagacacagctgggtctggctgcttggcttcccccgagaactctccctgagccctctgcttatgacattgcttcacttttgtgacatcgcttaatttttgtgatgttgcttcacttttgtcatattttattcatcagaaagaaggcaccaggtctaacccacactcctgaaaaggggattgcacagaggcacaaagacctctggtgtttccagtccgggtagactggctgtcaccactggggcactggtgggtacctgtgagctgatgagtgggaccaaacggctctggccaccttggaccccattcctcccaggctttgtctctccctgagccctgcgcttgagaacattaaaagccatgccttggacccccttgttctgagtcctgccatgggccgtgaggacagccggccactcttcctggtgagcagattgtcacttggctccagctgcacgtccagctcttccgctgttttgctcacggtaaatgcgtcactggagaagggaaggtggatttttgcggttccacgtgcctggcacaaggatatcatttggtaaggaaacttgttggagaatgtgtgaaggcccagggtttgttctttcctctcttccagctgtgcttactggctggagagaagggtttggattcgtctcgttactcttggctgctgggcccttcttcctttgtcggctgttcagaagtgggaaaatatatatttttttatccctctccttctttgtctctttgtctgtgtctgtctgtctgtctctctcacgcacacaccctccatcctctgatcccattctagcttccctgctttatttcccactgatttctttaatgccccaatcacatataaactaaaccattttctgttccttgcgttctggctcttgggtggtcctagttaaccagctttcacagggcagcgtttcccctttggtgtgattcacattaaaggtgagacttagacgctgtctgaagtgcaggcaatttactctggcagcaatctcacaacacggacagcaggagcaggctggtggccaaacacaaggtccagatgaccacccgactgggaagggtctccatctggcgaccgttctcggagtttgagggattcttcctcctttcttacacctgtactcagtccaggtcagttcccaggtgtttctttcataatggagctttaagctattctggtaagggtgagctttgttttaaggtttgtgaaagttgtgtctgtgctagatggccttatctctagggcaactaggattttgggatccagttgacatagagacccagtaatccctgggccagggctggaaatcccaggccaggttgcatcatactgctaagtgtgtaggtcctgtgagatgtttgagtgggcgtatggctgtcattaatcttatagccatggtatctcatagtatactacagtgtgtctttgtttgtgttagtctactggaaatgaccttctcttatgactctaacatttaccccattccttaaaaaaatctgctgtaaagcaatatttacaatcagaaacctggaaaatatacaaatatatatctctacatttgtagaatgatttctatgcatatatatatataagaaatacggaaatgtataaagtagaaagcaaaaccccataactttatcacctggctgtaatcattccgattcattcttttagattatttttcttctttctttctttttcttttctttcttgcaactccctgatatgatgagagatccttgaggcccacttcaagtgcaagtctcctcagacacctttttatatcattattcctagccaaaagagatggtgtctttctcagtacccctagaatgttagtgctcctgctcgtcactgtgtgttcggggtcattgtattagttatctattgtattgcaaattacccccaaaattatctattgttgtattgcaaaaattactattgcaaaatagtggcttaaaacagcagccatttactattacacagtttctctgggtcaggagtctgtatccagctttactaggttctctgtccaggatctctgacaggctgcactcaaggtgtcagcggactgcagtctcacctgaaggctcggctaggggggaactgcatccaggcttacgcatggtctgagggcttccaggccttgctggctccctcagacctttgccacatgggcctctctgttgagcagctcactgcatggcagctggcttccagcagagtgaccaggggagacagcaagagagcctttttgtaatctgatcttggaggtgacattgcttcacttctgtcatattttattcattaggaagaagtcaccaggtctaacccacactcatgggaagagggttgcacaaaggcataaagaccaggaggcagggaccactggggtccatccaagaagttgcctgccgcagacaatcctgcttatgagcctgtgctggactgcatgccatcttgggcagagccctgccttatctttatatgtctaatgagatcgtgtatcttgtgcctgatgggcactcagaaacccactttgctgttccctctttcgtctctcatagcaggcgtggtggcatacgcctgtggtctcagctgcttgggaggctgaggcaggagaattgcttgaacttgcgaggtggaggttgcagtgagccgggatcacgtggctgcactccagcctggtcaacagggcaagactctgtctcaaaaa

SEQ ID NO: 172 - DNA, 1668 bp, Homo sapiens
  nbla20421
ctttctgcgctagtttattacatttagtacatttgtattgtatgaaaagcaacagcccagattatttgatccccgtctgtgttaatctttccttcctgcctctcccttttttttttttgcggcggcgggggcggttggcctttctttgtttttgtttttttttctatgttcctgtcccttatttttaaaaatctcttttagcaacagggatatcatcaccacgctggtatcctcacatgtgtgggttttgctgagctagtagaaaatgatccaaagatgattggtgaccaaatgtctgattgcaacatttcgttttcctccgtggtacatagctccaggctgccagtctcctatttgtggataatcccgtgggcactgggttcagttatgtgaatggtagtggtgcctatgccaaggacctggctatggtggcttcagacatgatggttctcctgaagaccttcttcagttgccacaaagaattccaggtaagcaaagactcaggaacagctaagtaaagggctggcaatatcaactctacatccatcagcataaacctgaactgcctccagagtttaatgcctagctgatttcagagaaaactttttaattcccaagattgggttgtggacttttgtttctgtcatctctaaagttgatatttaacttgaaagaatgaccttggagtgagcattctaatcagacgcaataatcagatatggagtggtgggggaggaagacaaagcagatttgtttttttctggtcattacgtgcaatagaaatttgaaattaatttgtgtgactcagaaagcaatcaaggtagttaattctgtgtaaattccttttcttgctagacagttccattctacattttctcagagtcctatggaggaaaaatggcagctggcattggtctagagctttataaggtaatggaaaataactttgttgttatggttttggacagaaaatcaattatgttacttttatgtactcacgtgctattaaatatactttgaatagggccatgtacatgcagagtacgattaaatctgtagtaataaccataaaaagtttttaaaagaagaatgaagattgccctgctagatctggaacaagatataaagcatgagtgagtaaaagaatgtggtactaacatagcaatagacaaataggttaattgcaacaggatacagaatccagaaacacacacacatatatatgtatgtgtatcatatatttgtattttatataaatatatatgatcatatataaatataagataacgtttcaaatcattggggcatggatataatgtcgataaatgttatggagacaaatacctatcactttggaaaatagaaaacttgtattcctgccttgtataaaatattaattctggatggattaaaatctaaacataaaaataaaaataatggagacaaatacctatcactttggaaaatagaaaacttgtattcttgccttgtataaaatattaattctggatggattaaaatctaaacataaaaataaaaattaggacagaatgcagtggcccacgcctataatcccagcactttgggaagcccaggcaggaggactgcttgtgaccaggagttccagaccagcctgggcaacatagcgacaccctgtttctacaaaaa

SEQ ID NO: 173 - DNA, 1559 bp, Homo sapiens
  nbla22298
gctgaaaagggaaaaatcgtgggcaattctgacgccagtgagcattgccagttcttccttcaggcactgttctatagggaaggaggttagaaactcagattcatggatgttgctaagagcaacccggaactcagacatttttcactgtgctttccttggcatgccaactcgaaggagaaatgttagcaatggggcacagggagaaaccgtgccagtaggtatggtattgttaggtaaaatggagcagccttgcttgtttggggaacctttcagtctccccaactatggactatcgggttcctgattttccaagtccctgctgagggtgggatgttgtgtggatgatgtctttcccctctgcagtggttgtggcacacacagacgtgtgaaccttgaccacaggctcgacacaccctggtgtcatcgggtgggttgtgttccagtggccctgagccaagcaagaccccaggaaagactctggaaaactgaagggggctggatgtcacccacagtacataccttgtgcctgtaacgaagcaggcactggtttcatttaggaaaggtattgtgtccgaagccccatttttagactgttaaaagtatacaaacagaaacgaacaccattgccttaggtgcaaagcacacttttttattttaatagaagcccaggcttgcacaacaccaccttcatgaagattggtcatttctgaggatgacaaaaccacaaagtttattgagattgctccttcattgacagtctctaagcacttcagaagcaatgacaaggcaaactctgtgggatgatgacaagggtccctcgcgctgcggcagtggagagtgtgtctgagccaggctgtctgtggggagaccccaccccacccctgagacctgggtgacttggcacctgtccacggctctgcttctccatccacaaatgggaaatatcacaggccctgccttgtgtgttattgatataagaacttggaaaagagcttgctgtaatagtaagcatggtagatgttggctgcaataaataattgtgttgctgggaactcagcaacattaggataatattaaaaataaaatttaaagatttttctgggatatgtgttaattgcaacggttaaataaggtaaacttcatgaagacatgtatagaattttagttatctataggtaaactacttattttaattcatcatggactaaggggacaaaactgcacccacacacacacatacacacacacaaacgtacacacagtaaatattttcatgatatcgtctagggatgtcaaattaacaaaaattaacataaaaacagatgcattttcaatgagattatcatcagatattatttatgaacagcttaaatagaatgaagacttggaaggatttgggggaaggctcgcatgtgagtgtgtgtgtttgtttgtgtgtgtgagtgtgtgtgtgtttgcccttttttccctttgttttcaggatagttccatttagaaaaaaaagctttcctaccaaatttgcagatatctgcaaataatattctgccaagaagcaaaaa

SEQ ID NO: 174 - DNA, 1557 bp, Homo sapiens
  nbla22549
gaaaaaactaaagtaccttgaaaggttacacattcagcaaaccatgaagataatagctattctttattaaacactgtgtgccaagcaatagactaggcaatttttagatacgttacctgcaacctgtacaacatttctacactttatggatgggaaacggagacatgggaagtgtggctgagttgttcatggatgtagaaatagtaaacggcagagtaggaaagtgaaaccgcctatctctgacctggaggtctgcctgtatctttcccactccaccacactgcacgtgggtgtcccgaaaccaccttcccagattcctgactctcagtaattttattatggacaacatgcatgagtagtcatcatatttttcaagtgaaatatcgggacatgatataacacatgacttaacaatggtactgaatatttgaaatcaggcctttcccggaaaatcatgcatgaaggatcattataaacaaacatagcaaccagttgtctccccgaacttgtcacttttctcataaatgtctggcctggagctccaaaatcatccaaatacttagtagcattttagcctgagtacactttctcagttcctcaactctttgtatacctttccaccaatatagacattctagaatctgcttcagatgcatttgaaattttcacccccatggaactagtgattaatatcagagcccactcttgcagttggtaatggggtggcaatcaaacgttcagatgatgataaaggagagataatggataattctttttcagagttctcacttaacagctctgttgtggaatgttttaaatagtcttataaataatttgtttatagtattgttgttagtttaattgaattttatgtaagaagctgtccaacatcagagaaatgaaattcctcccactttctgtgtagaacaaggtctctgacagtattgattcatggaagtactaatggacttagaaaacattaagagaatgtcatttctcatagtgtttctgtttctgaaaatgaatctcctgaattattatctttctccctgttacttggctggggaaagagatagaagctgtataaacaaattctcttccatgctcaaagcaagtgttccatgtgcacaacctgctgcagactggggcccttctcagttaattgggtttcacaagcaataatttctccacaacaaaaaccacaacttgaagtgagttgaaaagagatcaatagtggaaacagtcgcctcagtactttttctttctggatttcatctctagaaatttgaagtgtttgagacagagtccaccctttgtgcaaggcgagaaccaatgaatggactccttgtgtgaattattgcatcttcttccaaagcaggttcatcaagactttcacagagattcatttttgttgagaagtaagggttaataggaggatagaatttggatccaaatctagtgataaaagtgtccaagcaatcataaagtaagatattttagggacataccaacatcttccctttctgctaatttcatgctccaaagatatggcaaaaa

SEQ ID NO: 175 - DNA, 20 bp, Artificial Sequence
  Description of Artificial Sequence: Synthetic primer: nbla22420-1-1f
gcctactggaatggaaacac

SEQ ID NO: 176 - DNA, 20 bp, Artificial Sequence
  Description of Artificial Sequence: Synthetic primer: nbla22420-1-1r
caaaggctatccaaaagcaa

SEQ ID NO: 177 - DNA, 19 bp, Artificial Sequence
  Description of Artificial Sequence: Synthetic primer: nbla22689-1f
cggattctggtgggttctt

SEQ ID NO: 178 - DNA, 21 bp, Artificial Sequence
  Description of Artificial Sequence: Synthetic primer: nbla22689-1r
agagtgaggggaacaaagtgg

SEQ ID NO: 179 - DNA, 21 bp, Artificial Sequence
  Description of Artificial Sequence: Synthetic primer: nbla24135-1f
gaggacaccagcgtagaagag

SEQ ID NO: 180 - DNA, 20 bp, Artificial Sequence
  Description of Artificial Sequence: Synthetic primer: nbla24135-1r
ggaagaaactgaggcagagg

SEQ ID NO: 181 - DNA, 19 bp, Artificial Sequence
  Description of Artificial Sequence: Synthetic primer: nbla24350-1f
tcccaggagaaatgaatgg

SEQ ID NO: 182 - DNA, 18 bp, Artificial Sequence
  Description of Artificial Sequence: Synthetic primer: nbla24350-1r
gtgtttggccctttggag

SEQ ID NO: 183 - DNA, 20 bp, Artificial Sequence
  Description of Artificial Sequence: Synthetic primer: nbla23701-1f
agccctcaccccaagtaaag

SEQ ID NO: 184 - DNA, 20 bp, Artificial Sequence
  Description of Artificial Sequence: Synthetic primer: nbla23701-1r
cagcgagctagagtgaacga

SEQ ID NO: 185 - DNA, 19 bp, Artificial Sequence
  Description of Artificial Sequence: Synthetic primer: nbla23890-1f
tggaaaagacaccgggaag

SEQ ID NO: 186 - DNA, 21 bp, Artificial Sequence
  Description of Artificial Sequence: Synthetic primer: nbla23890-1r
ccttggacaggtttttgttgg

SEQ ID NO: 187 - DNA, 20 bp, Artificial Sequence
  Description of Artificial Sequence: Synthetic primer: nbla21650-1f
cagttttctccacggtccaa

SEQ ID NO: 188 - DNA, 19 bp, Artificial Sequence
  Description of Artificial Sequence: Synthetic primer: nbla21650-1r
atgggtggctgagatgagg

SEQ ID NO: 189 - DNA, 20 bp, Artificial Sequence
  Description of Artificial Sequence: Synthetic primer: nbla22094-1f
ggtcaggatttccccttttc

SEQ ID NO: 190 - DNA, 20 bp, Artificial Sequence
  Description of Artificial Sequence: Synthetic primer: nbla22094-1r
tcctagaaggctgggctaca

SEQ ID NO: 191 - DNA, 21 bp, Artificial Sequence
  Description of Artificial Sequence: Synthetic primer: nbla22739-1f
cgacgaatctctgcaatctct

SEQ ID NO: 192 - DNA, 20 bp, Artificial Sequence
  Description of Artificial Sequence: Synthetic primer: nbla22739-1r
tgcccatgaatctcctaacc

SEQ ID NO: 193 - DNA, 21 bp, Artificial Sequence
  Description of Artificial Sequence: Synthetic primer: nbla23525-1f
tctgccatcaacttctttcct

SEQ ID NO: 194 - DNA, 23 bp, Artificial Sequence
  Description of Artificial Sequence: Synthetic primer: nbla23525-1r
ccatctctttctttcttgcactc

SEQ ID NO: 195 - DNA, 21 bp, Artificial Sequence
  Description of Artificial Sequence: Synthetic primer: nbla20226r1-1f
caagcaacaatgacgaatgag

SEQ ID NO: 196 - DNA, 22 bp, Artificial Sequence
  Description of Artificial Sequence: Synthetic primer: nbla20226r1-1r
ggaggaatgagaatgaggtttg

SEQ ID NO: 197 - DNA, 21 bp, Artificial Sequence
  Description of Artificial Sequence: Synthetic primer: nbla22182-1f
ttggaagcaggacatggatag

SEQ ID NO: 198 - DNA, 20 bp, Artificial Sequence
  Description of Artificial Sequence: Synthetic primer: nbla22182-1r
tggacacatggtggtgaaag

SEQ ID NO: 199 - DNA, 18 bp, Artificial Sequence
  Description of Artificial Sequence: Synthetic primer: nbla23256-1f
ttgggggcaggagattac

SEQ ID NO: 200 - DNA, 22 bp, Artificial Sequence
  Description of Artificial Sequence: Synthetic primer: nbla23256-1r
cctggctacatagagaaaccaa

SEQ ID NO: 201 - DNA, 23 bp, Artificial Sequence
  Description of Artificial Sequence: Synthetic primer: nbla21297-1f
acaacgctagtcccacttacaac

SEQ ID NO: 202 - DNA, 20 bp, Artificial Sequence
  Description of Artificial Sequence: Synthetic primer: nbla21297-1r
gctcctctggctcaacaatc

SEQ ID NO: 203 - DNA, 25 bp, Artificial Sequence
  Description of Artificial Sequence: Synthetic primer: nbla20787-1f
gagataggttctcttctgagtttgt

SEQ ID NO: 204 - DNA, 21 bp, Artificial Sequence
  Description of Artificial Sequence: Synthetic primer: nbla20787-1r
caggtaagtttgtcctccatc

SEQ ID NO: 205 - DNA, 19 bp, Artificial Sequence
  Description of Artificial Sequence: Synthetic primer: nbla22284-1f
ctaccgatccccagacaca

SEQ ID NO: 206 - DNA, 18 bp, Artificial Sequence
  Description of Artificial Sequence: Synthetic primer: nbla22284-1r
cagcaacagccagaacca

SEQ ID NO: 207 - DNA, 20 bp, Artificial Sequence
  Description of Artificial Sequence: Synthetic primer: nbla20123-1f
cgagagccatgcaaaaacac

SEQ ID NO: 208 - DNA, 20 bp, Artificial Sequence
  Description of Artificial Sequence: Synthetic primer: nbla20123-1r
gcacagaaaatggaggcaga

SEQ ID NO: 209 - DNA, 20 bp, Artificial Sequence
  Description of Artificial Sequence: Synthetic primer: nbla20382-1f
gttcagtgcagtcaggatgg

SEQ ID NO: 210 - DNA, 22 bp, Artificial Sequence
  Description of Artificial Sequence: Synthetic primer: nbla20382-1r
gtcacactctttgctttgcttg

SEQ ID NO: 211 - DNA, 19 bp, Artificial Sequence
  Description of Artificial Sequence: Synthetic primer: nbla20660r1-1f
gcgttcttccacaccaaac

SEQ ID NO: 212 - DNA, 20 bp, Artificial Sequence
  Description of Artificial Sequence: Synthetic primer: nbla20660r1-1f
tccgaggaaaaggtgcttac

SEQ ID NO: 213 - DNA, 21 bp, Artificial Sequence
  Description of Artificial Sequence: Synthetic primer: nbla20666-1f
tctggctgggtttatagcttg

SEQ ID NO: 214 - DNA, 18 bp, Artificial Sequence
  Description of Artificial Sequence: Synthetic primer: nbla20666-1r
taccggctgttggtgttg

SEQ ID NO: 215 - DNA, 20 bp, Artificial Sequence
  Description of Artificial Sequence: Synthetic primer: nbla21239-1f
gcccagcctatgtctgtatc

SEQ ID NO: 216 - DNA, 20 bp, Artificial Sequence
  Description of Artificial Sequence: Synthetic primer: nbla21239-1r
tcctggtacactgcctcttc

SEQ ID NO: 217 - DNA, 25 bp, Artificial Sequence
  Description of Artificial Sequence: Synthetic primer: nbla21729-1f
gacatttctaccaatctgtgtgtct

SEQ ID NO: 218 - DNA, 22 bp, Artificial Sequence
  Description of Artificial Sequence: Synthetic primer: nbla21729-1r
cacttgtgcttcttttctctgg

SEQ ID NO: 219 - DNA, 21 bp, Artificial Sequence
  Description of Artificial Sequence: Synthetic primer: nbla21831-1f
ggaaccgtagacttgttcgtg

SEQ ID NO: 220 - DNA, 20 bp, Artificial Sequence
  Description of Artificial Sequence: Synthetic primer: nbla21831-1r
actcccagaattggaatgga

SEQ ID NO: 221 - DNA, 19 bp, Artificial Sequence
  Description of Artificial Sequence: Synthetic primer: nbla22826-1f
gcaatccttccccttcctt

SEQ ID NO: 222 - DNA, 20 bp, Artificial Sequence
  Description of Artificial Sequence: Synthetic primer: nbla22826-1r
tgtcacgaccttccctgttc

SEQ ID NO: 223 - DNA, 21 bp, Artificial Sequence
  Description of Artificial Sequence: Synthetic primer: nbla23899-1f
cagggggattgataacacaga

SEQ ID NO: 224 - DNA, 20 bp, Artificial Sequence
  Description of Artificial Sequence: Synthetic primer: nbla23899-1r
ggatgaaatgcaaggcagag

SEQ ID NO: 225 - DNA, 20 bp, Artificial Sequence
  Description of Artificial Sequence: Synthetic primer: nbla20578-1f
catctgcatccaaaccaaag

SEQ ID NO: 226 - DNA, 21 bp, Artificial Sequence
  Description of Artificial Sequence: Synthetic primer: nbla20578-1r
agttagaatcccaagccgaag

SEQ ID NO: 227 - DNA, 20 bp, Artificial Sequence
  Description of Artificial Sequence: Synthetic primer: nbla21908-1f
agtctgcgggtctggtttct

SEQ ID NO: 228 - DNA, 20 bp, Artificial Sequence
  Description of Artificial Sequence: Synthetic primer: nbla21908-1r
tgcaaagttcccctgcttac

SEQ ID NO: 229 - DNA, 20 bp, Artificial Sequence
  Description of Artificial Sequence: Synthetic primer: nbla22027-1f
agttggtggatggatcttgg

SEQ ID NO: 230 - DNA, 20 bp, Artificial Sequence
  Description of Artificial Sequence: Synthetic primer: nbla22027-1r
gatgaaccgaaacaggaagg

SEQ ID NO: 231 - DNA, 20 bp, Artificial Sequence
  Description of Artificial Sequence: Synthetic primer: nbla22082-1f
tgtgctgaaaatccgaagtg

SEQ ID NO: 232 - DNA, 20 bp, Artificial Sequence
  Description of Artificial Sequence: Synthetic primer: nbla22082-1r
gcaatgtagtggggtcgaag

SEQ ID NO: 233 - DNA, 20 bp, Artificial Sequence
  Description of Artificial Sequence: Synthetic primer: nbla23303-1f
cttgagctgagatggactgg

SEQ ID NO: 234 - DNA, 19 bp, Artificial Sequence
  Description of Artificial Sequence: Synthetic primer: nbla23303-1r
cagcaggcagattccaaag

SEQ ID NO: 235 - DNA, 25 bp, Artificial Sequence
  Description of Artificial Sequence: Synthetic primer: nbla20264-1f
gtcttctctaccctctcccttaatc

SEQ ID NO: 236 - DNA, 20 bp, Artificial Sequence
  Description of Artificial Sequence: Synthetic primer: nbla20264-1r
caccagtcctagcagcaaca

SEQ ID NO: 237 - DNA, 19 bp, Artificial Sequence
  Description of Artificial Sequence: Synthetic primer: nbla20269r1-1f
agccaaactggaggtgatg

SEQ ID NO: 238 - DNA, 18 bp, Artificial Sequence
  Description of Artificial Sequence: Synthetic primer: nbla20269r1-1r
ccgtgaaaggctgaaagg

SEQ ID NO: 239 - DNA, 21 bp, Artificial Sequence
  Description of Artificial Sequence: Synthetic primer: nbla20406-1f
tccaactcacagaaatgcaag

SEQ ID NO: 240 - DNA, 21 bp, Artificial Sequence
  Description of Artificial Sequence: Synthetic primer: nbla20406-1r
aagtctcatccaaagccaaag

SEQ ID NO: 241 - DNA, 22 bp, Artificial Sequence
  Description of Artificial Sequence: Synthetic primer: nbla20949-1f
ttcaaactataccctccctttg

SEQ ID NO: 242 - DNA, 20 bp, Artificial Sequence
  Description of Artificial Sequence: Synthetic primer: nbla20949-1r
cagttggtttccacattcct

SEQ ID NO: 243 - DNA, 20 bp, Artificial Sequence
  Description of Artificial Sequence: Synthetic primer: nbla21251-1f
cttctttcccaagtgccaag

SEQ ID NO: 244 - DNA, 21 bp, Artificial Sequence
  Description of Artificial Sequence: Synthetic primer: nbla21251-1r
tggctcaataaccacaggaag

SEQ ID NO: 245 - DNA, 19 bp, Artificial Sequence
  Description of Artificial Sequence: Synthetic primer: nbla21334-1f
tggctgggttattcccttt

SEQ ID NO: 246 - DNA, 25 bp, Artificial Sequence
  Description of Artificial Sequence: Synthetic primer: nbla21334-1r
gttcaatgttctcttgctacttgtg

SEQ ID NO: 247 - DNA, 21 bp, Artificial Sequence
  Description of Artificial Sequence: Synthetic primer: nbla21356-1f
actgaggagatggagtggttg

SEQ ID NO: 248 - DNA, 19 bp, Artificial Sequence
  Description of Artificial Sequence: Synthetic primer: nbla21356-1r
atatgggctgatggttgga

SEQ ID NO: 249 - DNA, 21 bp, Artificial Sequence
  Description of Artificial Sequence: Synthetic primer: nbla21418-1f
gagggtgagctgggatatgtt

SEQ ID NO: 250 - DNA, 20 bp, Artificial Sequence
  Description of Artificial Sequence: Synthetic primer: nbla21418-1r
accggcctctctgtttttct

SEQ ID NO: 251 - DNA, 20 bp, Artificial Sequence
  Description of Artificial Sequence: Synthetic primer: nbla21480-1f
tgggagcagaacaaaatgaa

SEQ ID NO: 252 - DNA, 22 bp, Artificial Sequence
  Description of Artificial Sequence: Synthetic primer: nbla21480-1r
aacaccatcaaccagaacagag

SEQ ID NO: 253 - DNA, 20 bp, Artificial Sequence
  Description of Artificial Sequence: Synthetic primer: nbla21509-1f
caaagacagtggaagctgga

SEQ ID NO: 254 - DNA, 19 bp, Artificial Sequence
  Description of Artificial Sequence: Synthetic primer: nbla21509-1r
ctgtttgtcccaggaggtg

SEQ ID NO: 255 - DNA, 21 bp, Artificial Sequence
  Description of Artificial Sequence: Synthetic primer: nbla21527-1f
ggacaggtagtgtttgggaag

SEQ ID NO: 256 - DNA, 19 bp, Artificial Sequence
  Description of Artificial Sequence: Synthetic primer: nbla21527-1r
cgtaccccagatggagaga

SEQ ID NO: 257 - DNA, 20 bp, Artificial Sequence
  Description of Artificial Sequence: Synthetic primer: nbla21551-1f
caggaaaacgtggaagttgg

SEQ ID NO: 258 - DNA, 20 bp, Artificial Sequence
  Description of Artificial Sequence: Synthetic primer: nbla21551-1r
acagtgcccagacacacaga

SEQ ID NO: 259 - DNA, 23 bp, Artificial Sequence
  Description of Artificial Sequence: Synthetic primer: nbla21735-1f
catggctctaaaaggacaagaag

SEQ ID NO: 260 - DNA, 20 bp, Artificial Sequence
  Description of Artificial Sequence: Synthetic primer: nbla21735-1r
tgcctgaaggacactgaaga

SEQ ID NO: 261 - DNA, 19 bp, Artificial Sequence
  Description of Artificial Sequence: Synthetic primer: nbla22247-1-1f
caccgtcctcacattcaca

SEQ ID NO: 262 - DNA, 20 bp, Artificial Sequence
  Description of Artificial Sequence: Synthetic primer: nbla22247-1-1r
ttcatccaagctcgacacac

SEQ ID NO: 263 - DNA, 20 bp, Artificial Sequence
  Description of Artificial Sequence: Synthetic primer: nbla22477-1f
cataggaggcttgttttcca

SEQ ID NO: 264 - DNA, 21 bp, Artificial Sequence
  Description of Artificial Sequence: Synthetic primer: nbla22477-1r
tcgtaggcaaatcagtcaaag

SEQ ID NO: 265 - DNA, 20 bp, Artificial Sequence
  Description of Artificial Sequence: Synthetic primer: nbla22639-1f
tgacagcaacctgcaaagag

SEQ ID NO: 266 - DNA, 20 bp, Artificial Sequence
  Description of Artificial Sequence: Synthetic primer: nbla22639-1r
aagggatagacaccgcaaca

SEQ ID NO: 267 - DNA, 21 bp, Artificial Sequence
  Description of Artificial Sequence: Synthetic primer: nbla23174-1f
ggagggatcaccaaaacaaag

SEQ ID NO: 268 - DNA, 22 bp, Artificial Sequence
  Description of Artificial Sequence: Synthetic primer: nbla23174-1r
ttatgctctctgaaggggaatg

SEQ ID NO: 269 - DNA, 19 bp, Artificial Sequence
  Description of Artificial Sequence: Synthetic primer: nbla23198-1f
acaggcagtcctcgctttc

SEQ ID NO: 270 - DNA, 24 bp, Artificial Sequence
  Description of Artificial Sequence: Synthetic primer: nbla23198-1r
cagggtagctgtaaaaatgttggt

SEQ ID NO: 271 - DNA, 23 bp, Artificial Sequence
  Description of Artificial Sequence: Synthetic primer: nbla23328-1f
tgacacacacaagactcaagacc

SEQ ID NO: 272 - DNA, 20 bp, Artificial Sequence
  Description of Artificial Sequence: Synthetic primer: nbla23328-1r
atccaggcaatatccacacc

SEQ ID NO: 273 - DNA, 19 bp, Artificial Sequence
  Description of Artificial Sequence: Synthetic primer: nbla23420-1f
ggagcacaggccatcaaag

SEQ ID NO: 274 - DNA, 21 bp, Artificial Sequence
  Description of Artificial Sequence: Synthetic primer: nbla23420-1r
aggggacgaactctgaaacaa

SEQ ID NO: 275 - DNA, 23 bp, Artificial Sequence
  Description of Artificial Sequence: Synthetic primer: nbla23483-1f
gtaagtacgtgagccagtcatcc

SEQ ID NO: 276 - DNA, 22 bp, Artificial Sequence
  Description of Artificial Sequence: Synthetic primer: nbla23483-1r
cacctgtaactgaccagagcaa

SEQ ID NO: 277 - DNA, 22 bp, Artificial Sequence
  Description of Artificial Sequence: Synthetic primer: nbla23808-1f
tgttatgattggtcaggggtct

SEQ ID NO: 278 - DNA, 22 bp, Artificial Sequence
  Description of Artificial Sequence: Synthetic primer: nbla23808-1r
cagggtggattaggtgtctctc

SEQ ID NO: 279 - DNA, 19 bp, Artificial Sequence
  Description of Artificial Sequence: Synthetic primer: nbla23851-1f
cttttgacggggatttttg

SEQ ID NO: 280 - DNA, 20 bp, Artificial Sequence
  Description of Artificial Sequence: Synthetic primer: nbla23851-1r
accaccgttaccagtttgtg

SEQ ID NO: 281 - DNA, 20 bp, Artificial Sequence
  Description of Artificial Sequence: Synthetic primer: nbla24011-1f
gctgcaactgagacactgga

SEQ ID NO: 282 - DNA, 20 bp, Artificial Sequence
  Description of Artificial Sequence: Synthetic primer: nbla24011-1r
gtagcccatgaagtgggaag

SEQ ID NO: 283 - DNA, 25 bp, Artificial Sequence
  Description of Artificial Sequence: Synthetic primer: nbla24235-1f
gagatgaaatgtcttgaggaatgag

SEQ ID NO: 284 - DNA, 21 bp, Artificial Sequence
  Description of Artificial Sequence: Synthetic primer: nbla24235-1r
tgcaaagatgaaatggtcagg

SEQ ID NO: 285 - DNA, 20 bp, Artificial Sequence
  Description of Artificial Sequence: Synthetic primer: nbla24556-1f
gagcacaaaggatgggtagg

SEQ ID NO: 286 - DNA, 21 bp, Artificial Sequence
  Description of Artificial Sequence: Synthetic primer: nbla24556-1r
ctgggagacagacagaacaca

SEQ ID NO: 287 - DNA, 20 bp, Artificial Sequence
  Description of Artificial Sequence: Synthetic primer: nbla24800-1f
tgctgagtgatcctgttgag

SEQ ID NO: 288 - DNA, 19 bp, Artificial Sequence
  Description of Artificial Sequence: Synthetic primer: nbla24800-1r
gccagggtttagcatctgt

SEQ ID NO: 289 - DNA, 22 bp, Artificial Sequence
  Description of Artificial Sequence: Synthetic primer: nbla20001-1f
acagtcttctgttaggggatgg

SEQ ID NO: 290 - DNA, 20 bp, Artificial Sequence
  Description of Artificial Sequence: Synthetic primer: nbla20001-1r
gcagtatgaacgcgacaaag

SEQ ID NO: 291 - DNA, 22 bp, Artificial Sequence
  Description of Artificial Sequence: Synthetic primer: nbla20083-1f
gccagaatagaagggagagaga

SEQ ID NO: 292 - DNA, 22 bp, Artificial Sequence
  Description of Artificial Sequence: Synthetic primer: nbla20083-1r
tcttacccacccaaatccatac

SEQ ID NO: 293 - DNA, 20 bp, Artificial Sequence
  Description of Artificial Sequence: Synthetic primer: nbla20182-1f
atttgagtgaggccaacagg

SEQ ID NO: 294 - DNA, 19 bp, Artificial Sequence
  Description of Artificial Sequence: Synthetic primer: nbla20182-1r
ctggtgctttgggtatgga

SEQ ID NO: 295 - DNA, 22 bp, Artificial Sequence
  Description of Artificial Sequence: Synthetic primer: nbla20248-1f
gcagaataactaagggcaaaca

SEQ ID NO: 296 - DNA, 22 bp, Artificial Sequence
  Description of Artificial Sequence: Synthetic primer: nbla20248-1r
gaatcccatcaaacagacagag

SEQ ID NO: 297 - DNA, 20 bp, Artificial Sequence
  Description of Artificial Sequence: Synthetic primer: nbla20250r1-1f
ggcccatagccagatactcc

SEQ ID NO: 298 - DNA, 19 bp, Artificial Sequence
  Description of Artificial Sequence: Synthetic primer: nbla20250r1-1r
taggcataccccctttcca

SEQ ID NO: 299 - DNA, 20 bp, Artificial Sequence
  Description of Artificial Sequence: Synthetic primer: nbla20330-1f
gccaaggtgacagaggagtt

SEQ ID NO: 300 - DNA, 20 bp, Artificial Sequence
  Description of Artificial Sequence: Synthetic primer: nbla20330-1r
gttccagttgtttccggttc

SEQ ID NO: 301 - DNA, 23 bp, Artificial Sequence
  Description of Artificial Sequence: Synthetic primer: nbla23983-1f
gctcctagattgtactggggttg

SEQ ID NO: 302 - DNA, 20 bp, Artificial Sequence
  Description of Artificial Sequence: Synthetic primer: nbla23983-1r
tggcttttggaagaactgga

SEQ ID NO: 303 - DNA, 22 bp, Artificial Sequence
  Description of Artificial Sequence: Synthetic primer: nbla24111r1-1f
tctgcatcaggctttagtgtgt

SEQ ID NO: 304 - DNA, 21 bp, Artificial Sequence
  Description of Artificial Sequence: Synthetic primer: nbla24111r1-1r
ctggcattttgaggatattgg

SEQ ID NO: 305 - DNA, 21 bp, Artificial Sequence
  Description of Artificial Sequence: Synthetic primer: nbla24142-1f
tctgaaccctgttaccattcc

SEQ ID NO: 306 - DNA, 20 bp, Artificial Sequence
  Description of Artificial Sequence: Synthetic primer: nbla24142-1r
tgatgaaagccgtgaacaac

SEQ ID NO: 307 - DNA, 22 bp, Artificial Sequence
  Description of Artificial Sequence: Synthetic primer: nbla24157-1f
cattctcatgtctccatttgct

SEQ ID NO: 308 - DNA, 22 bp, Artificial Sequence
  Description of Artificial Sequence: Synthetic primer: nbla24157-1r
ctttctttctaccatgcgctac

SEQ ID NO: 309 - DNA, 19 bp, Artificial Sequence
  Description of Artificial Sequence: Synthetic primer: nbla24230-1f
gtctgccacccaataagca

SEQ ID NO: 310 - DNA, 19 bp, Artificial Sequence
  Description of Artificial Sequence: Synthetic primer: nbla24230-1r
cctccacaacaggcacatc

SEQ ID NO: 311 - DNA, 21 bp, Artificial Sequence
  Description of Artificial Sequence: Synthetic primer: nbla20541-1f
tgagtggacttcggttccttc

SEQ ID NO: 312 - DNA, 21 bp, Artificial Sequence
  Description of Artificial Sequence: Synthetic primer: nbla20541-1r
aggcagcattcacccttaaca

SEQ ID NO: 313 - DNA, 19 bp, Artificial Sequence
  Description of Artificial Sequence: Synthetic primer: nbla20555-1f
agtatgtgcgttccgtggt

SEQ ID NO: 314 - DNA, 20 bp, Artificial Sequence
  Description of Artificial Sequence: Synthetic primer: nbla20555-1r
gtgctaggggatgggtaatg

SEQ ID NO: 315 - DNA, 20 bp, Artificial Sequence
  Description of Artificial Sequence: Synthetic primer: nbla20645-1f
cgctgaatatggaggcaaag

SEQ ID NO: 316 - DNA, 18 bp, Artificial Sequence
  Description of Artificial Sequence: Synthetic primer: nbla20645-1r
gcccctttcttggaggtg

SEQ ID NO: 317 - DNA, 20 bp, Artificial Sequence
  Description of Artificial Sequence: Synthetic primer: nbla20713-1f
ctcccccatcgtatcctttc

SEQ ID NO: 318 - DNA, 18 bp, Artificial Sequence
  Description of Artificial Sequence: Synthetic primer: nbla20713-1r
gtccggcctttggttttc

SEQ ID NO: 319 - DNA, 19 bp, Artificial Sequence
  Description of Artificial Sequence: Synthetic primer: nbla24250-1f
ggcatttggggacctcttc

SEQ ID NO: 320 - DNA, 20 bp, Artificial Sequence
  Description of Artificial Sequence: Synthetic primer: nbla24250-1r
ctgtcttctttgccccttcc

SEQ ID NO: 321 - DNA, 21 bp, Artificial Sequence
  Description of Artificial Sequence: Synthetic primer: nbla24254-1f
acttggtgcctgaagaagaga

SEQ ID NO: 322 - DNA, 21 bp, Artificial Sequence
  Description of Artificial Sequence: Synthetic primer: nbla24254-1r
actgcgttaagatggaaaacc

SEQ ID NO: 323 - DNA, 23 bp, Artificial Sequence
  Description of Artificial Sequence: Synthetic primer: nbla24327-1f
ggtgctctactactccccttttc

SEQ ID NO: 324 - DNA, 22 bp, Artificial Sequence
  Description of Artificial Sequence: Synthetic primer: nbla24327-1r
ggtcatcatcagttcctttgct

SEQ ID NO: 325 - DNA, 20 bp, Artificial Sequence
  Description of Artificial Sequence: Synthetic primer: nbla24510-1f
ggcattagcctggaagaggt

SEQ ID NO: 326 - DNA, 18 bp, Artificial Sequence
  Description of Artificial Sequence: Synthetic primer: nbla24510-1r
cgcctgcgactgaaaaag

SEQ ID NO: 327 - DNA, 20 bp, Artificial Sequence
  Description of Artificial Sequence: Synthetic primer: nbla24554-1f
atgacagggtgggcttttac

SEQ ID NO: 328 - DNA, 19 bp, Artificial Sequence
  Description of Artificial Sequence: Synthetic primer: nbla24554-1r
ccagtttcgggatgtcctt

SEQ ID NO: 329 - DNA, 20 bp, Artificial Sequence
  Description of Artificial Sequence: Synthetic primer: nbla24604-1f
ctttccctcttccccaaaac

SEQ ID NO: 330 - DNA, 19 bp, Artificial Sequence
  Description of Artificial Sequence: Synthetic primer: nbla24604-1r
cttcccagaacagcaagca

SEQ ID NO: 331 - DNA, 19 bp, Artificial Sequence
  Description of Artificial Sequence: Synthetic primer: nbla21037-1f
cctgctggttgacctctcc

SEQ ID NO: 332 - DNA, 19 bp, Artificial Sequence
  Description of Artificial Sequence: Synthetic primer: nbla21037-1r
ctcatcctcatccgggtct

SEQ ID NO: 333 - DNA, 19 bp, Artificial Sequence
  Description of Artificial Sequence: Synthetic primer: nbla21161-1f
actcgcctgcctgattctt

SEQ ID NO: 334 - DNA, 21 bp, Artificial Sequence
  Description of Artificial Sequence: Synthetic primer: nbla21161-1r
cacttttccacaaacctccac

SEQ ID NO: 335 - DNA, 20 bp, Artificial Sequence
  Description of Artificial Sequence: Synthetic primer: nbla21170-1f
gctgcttcctctttggttct

SEQ ID NO: 336 - DNA, 20 bp, Artificial Sequence
  Description of Artificial Sequence: Synthetic primer: nbla21170-1r
ccaagtttgcatgtttttgg

SEQ ID NO: 337 - DNA, 18 bp, Artificial Sequence
  Description of Artificial Sequence: Synthetic primer: nbla21198-1f
ctgcctttccaccttgct

SEQ ID NO: 338 - DNA, 19 bp, Artificial Sequence
  Description of Artificial Sequence: Synthetic primer: nbla21198-1r
gtgtctgctggtgctcctc

SEQ ID NO: 339 - DNA, 20 bp, Artificial Sequence
  Description of Artificial Sequence: Synthetic primer: nbla21298-1f
taacttggccttggtgtttg

SEQ ID NO: 340 - DNA, 20 bp, Artificial Sequence
  Description of Artificial Sequence: Synthetic primer: nbla21298-1r
caacctgcctctgaatatgg

SEQ ID NO: 341 - DNA, 21 bp, Artificial Sequence
  Description of Artificial Sequence: Synthetic primer: nbla21379-1f
cgatagcaggtacaatgaagg

SEQ ID NO: 342 - DNA, 25 bp, Artificial Sequence
  Description of Artificial Sequence: Synthetic primer: nbla21379-1r
cacataaggtaagagatagcgaaag

SEQ ID NO: 343 - DNA, 20 bp, Artificial Sequence
  Description of Artificial Sequence: Synthetic primer: nbla24705-1f
agggctaggtgtgggttttc

SEQ ID NO: 344 - DNA, 21 bp, Artificial Sequence
  Description of Artificial Sequence: Synthetic primer: nbla24705-1r
gcccctctttgcactttactc

SEQ ID NO: 345 - DNA, 20 bp, Artificial Sequence
  Description of Artificial Sequence: Synthetic primer: nbla21385-1f
tgcttgctgaaaagtcgaaa

SEQ ID NO: 346 - DNA, 23 bp, Artificial Sequence
  Description of Artificial Sequence: Synthetic primer: nbla21385-1r
tagcgatggaaactaagagaagg

SEQ ID NO: 347 - DNA, 20 bp, Artificial Sequence
  Description of Artificial Sequence: Synthetic primer: nbla21416-1r1-1f
gccaaaatcatcaccaagga

SEQ ID NO: 348 - DNA, 18 bp, Artificial Sequence
  Description of Artificial Sequence: Synthetic primer: nbla21416-1r1-1f
attccccctccctccaaa

SEQ ID NO: 349 - DNA, 24 bp, Artificial Sequence
  Description of Artificial Sequence: Synthetic primer: nbla21599-1f
gagagttgggagatgtaaggaaag

SEQ ID NO: 350 - DNA, 22 bp, Artificial Sequence
  Description of Artificial Sequence: Synthetic primer: nbla21599-1r
gtgatatggttccctgttttgg

SEQ ID NO: 351 - DNA, 21 bp, Artificial Sequence
  Description of Artificial Sequence: Synthetic primer: nbla21681-1f
ggtaggagcaatgactgttgg

SEQ ID NO: 352 - DNA, 20 bp, Artificial Sequence
  Description of Artificial Sequence: Synthetic primer: nbla21681-1r
tcgtcagctctgcttttgag

SEQ ID NO: 353 - DNA, 22 bp, Artificial Sequence
  Description of Artificial Sequence: Synthetic primer: nbla21878-1f
ggaaggcaacacattcctacac

SEQ ID NO: 354 - DNA, 21 bp, Artificial Sequence
  Description of Artificial Sequence: Synthetic primer: nbla21878-1r
caaggtcattcttgggctctc

SEQ ID NO: 355 - DNA, 20 bp, Artificial Sequence
  Description of Artificial Sequence: Synthetic primer: nbla21922-1f
caccaagcagtgtgcctaaa

SEQ ID NO: 356 - DNA, 24 bp, Artificial Sequence
  Description of Artificial Sequence: Synthetic primer: nbla21922-1r
tgaggaaacccctaatcatctatc

SEQ ID NO: 357 - DNA, 20 bp, Artificial Sequence
  Description of Artificial Sequence: Synthetic primer: nbla22004-1f
ttggaatgtcgtgtgtgtgg

SEQ ID NO: 358 - DNA, 22 bp, Artificial Sequence
  Description of Artificial Sequence: Synthetic primer: nbla22004-1r
aggtcagagcaatgagtgaagg

SEQ ID NO: 359 - DNA, 20 bp, Artificial Sequence
  Description of Artificial Sequence: Synthetic primer: nbla22004-2-1f
cagtaagtgcattggcagga

SEQ ID NO: 360 - DNA, 20 bp, Artificial Sequence
  Description of Artificial Sequence: Synthetic primer: nbla22004-2-1r
gctttttatggctgctgtgg

SEQ ID NO: 361 - DNA, 22 bp, Artificial Sequence
  Description of Artificial Sequence: Synthetic primer: nbla22085-1f
acccaatttaacctccctttct

SEQ ID NO: 362 - DNA, 20 bp, Artificial Sequence
  Description of Artificial Sequence: Synthetic primer: nbla22085-1r
tgcaaaagcaaagagcacac

SEQ ID NO: 363 - DNA, 18 bp, Artificial Sequence
  Description of Artificial Sequence: Synthetic primer: nbla22119r1-1f
gaggccacatgaaagaca

SEQ ID NO: 364 - DNA, 18 bp, Artificial Sequence
  Description of Artificial Sequence: Synthetic primer: nbla22119r1-1r
ctgatgacagggcagaga

SEQ ID NO: 365 - DNA, 19 bp, Artificial Sequence
  Description of Artificial Sequence: Synthetic primer: nbla22149-1f
ccagtgttttgctcttggt

SEQ ID NO: 366 - DNA, 20 bp, Artificial Sequence
  Description of Artificial Sequence: Synthetic primer: nbla22149-1r
gaaatcctcacttggatggt

SEQ ID NO: 367 - DNA, 22 bp, Artificial Sequence
  Description of Artificial Sequence: Synthetic primer: nbla22161-1f
cgaagttggtgttttctctgtt

SEQ ID NO: 368 - DNA, 22 bp, Artificial Sequence
  Description of Artificial Sequence: Synthetic primer: nbla22161-1r
taactgatgccccttagtcttg

SEQ ID NO: 369 - DNA, 20 bp, Artificial Sequence
  Description of Artificial Sequence: Synthetic primer: nbla22252-1f
tgagggtcttcttgcttggt

SEQ ID NO: 370 - DNA, 22 bp, Artificial Sequence
  Description of Artificial Sequence: Synthetic primer: nbla22252-1r
ccatttggtgtgtcctattttg

SEQ ID NO: 371 - DNA, 23 bp, Artificial Sequence
  Description of Artificial Sequence: Synthetic primer: nbla22347-1f
ccttggagttagaagagaaagga

SEQ ID NO: 372 - DNA, 20 bp, Artificial Sequence
  Description of Artificial Sequence: Synthetic primer: nbla22347-1r
agaaaggaagggcagaaatg

SEQ ID NO: 373 - DNA, 20 bp, Artificial Sequence
  Description of Artificial Sequence: Synthetic primer: nbla22352-1f
tggcattttcattgctacct

SEQ ID NO: 374 - DNA, 21 bp, Artificial Sequence
  Description of Artificial Sequence: Synthetic primer: nbla22352-1r
tggaaaccctaagaatcacct

SEQ ID NO: 375 - DNA, 21 bp, Artificial Sequence
  Description of Artificial Sequence: Synthetic primer: nbla22394-1f
tgttgagagacttccgctttc

SEQ ID NO: 376 - DNA, 20 bp, Artificial Sequence
  Description of Artificial Sequence: Synthetic primer: nbla22394-1r
ctggctgtggtttgctttct

SEQ ID NO: 377 - DNA, 21 bp, Artificial Sequence
  Description of Artificial Sequence: Synthetic primer: nbla22423-1f
cagggaagaaagccacagaag

SEQ ID NO: 378 - DNA, 22 bp, Artificial Sequence
  Description of Artificial Sequence: Synthetic primer: nbla22423-1r
ggcctgaaaagtcagagaaagg

SEQ ID NO: 379 - DNA, 20 bp, Artificial Sequence
  Description of Artificial Sequence: Synthetic primer: nnbla22439r1-1
ccatttgttcccctccttgt

SEQ ID NO: 380 - DNA, 20 bp, Artificial Sequence
  Description of Artificial Sequence: Synthetic primer: nbla22439r1-1r
ctttgagaggcgctttgatg

SEQ ID NO: 381 - DNA, 18 bp, Artificial Sequence
  Description of Artificial Sequence: Synthetic primer: nbla22633-1f
caggaagacgcagggaag

SEQ ID NO: 382 - DNA, 18 bp, Artificial Sequence
  Description of Artificial Sequence: Synthetic primer: nbla22633-1r
ggccttgaccttgtggtg

SEQ ID NO: 383 - DNA, 25 bp, Artificial Sequence
  Description of Artificial Sequence: Synthetic primer: nbla22698-1f
acttggcatcttactgatgtgattg

SEQ ID NO: 384 - DNA, 25 bp, Artificial Sequence
  Description of Artificial Sequence: Synthetic primer: nbla22698-1r
gctttcttatacctgggaaatcttg

SEQ ID NO: 385 - DNA, 20 bp, Artificial Sequence
  Description of Artificial Sequence: Synthetic primer: nbla22896-1f
tcgaggtgactcttctgacc

SEQ ID NO: 386 - DNA, 19 bp, Artificial Sequence
  Description of Artificial Sequence: Synthetic primer: nbla22896-1r
agggacagcttcatttcca

SEQ ID NO: 387 - DNA, 22 bp, Artificial Sequence
  Description of Artificial Sequence: Synthetic primer: nbla23167-1-1f
tagagaccccttcctatgcaac

SEQ ID NO: 388 - DNA, 20 bp, Artificial Sequence
  Description of Artificial Sequence: Synthetic primer: nbla23167-1-1r
ggctacagtttgcctctcca

SEQ ID NO: 389 - DNA, 22 bp, Artificial Sequence
  Description of Artificial Sequence: Synthetic primer: nbla23339-1f
tctcagctccagtaattccaca

SEQ ID NO: 390 - DNA, 21 bp, Artificial Sequence
  Description of Artificial Sequence: Synthetic primer: nbla23339-1r
gaaataaccccaattccacca

SEQ ID NO: 391 - DNA, 20 bp, Artificial Sequence
  Description of Artificial Sequence: Synthetic primer: nbla23352-1f
ggattggatgactccttgct

SEQ ID NO: 392 - DNA, 22 bp, Artificial Sequence
  Description of Artificial Sequence: Synthetic primer: nbla23352-1r
gactccctctttctcccttctc

SEQ ID NO: 393 - DNA, 24 bp, Artificial Sequence
  Description of Artificial Sequence: Synthetic primer: nbla23575-1f
ccagatattgatttcagagggaca

SEQ ID NO: 394 - DNA, 19 bp, Artificial Sequence
  Description of Artificial Sequence: Synthetic primer: nbla23575-1r
tggggacaaggggagaaag

SEQ ID NO: 395 - DNA, 22 bp, Artificial Sequence
  Description of Artificial Sequence: Synthetic primer: nbla23592-1f
tgatggcacttctaactctcct

SEQ ID NO: 396 - DNA, 21 bp, Artificial Sequence
  Description of Artificial Sequence: Synthetic primer: nbla23592-1r
gatcttgtacttcggcctttg

SEQ ID NO: 397 - DNA, 20 bp, Artificial Sequence
  Description of Artificial Sequence: Synthetic primer: nbla23601-1f
ccagcagcaaaggaaaactc

SEQ ID NO: 398 - DNA, 22 bp, Artificial Sequence
  Description of Artificial Sequence: Synthetic primer: nbla23601-1r
ctgggacaattcaaaagcctac

SEQ ID NO: 399 - DNA, 25 bp, Artificial Sequence
  Description of Artificial Sequence: Synthetic primer: nbla23630-1f
aaacgggctttagtcattttaggag

SEQ ID NO: 400 - DNA, 18 bp, Artificial Sequence
  Description of Artificial Sequence: Synthetic primer: nbla23630-1r
gcttttcccgcccacttt

SEQ ID NO: 401 - DNA, 24 bp, Artificial Sequence
  Description of Artificial Sequence: Synthetic primer: nbla23754-1f
tcagtcgtagtgtccaccttactc

SEQ ID NO: 402 - DNA, 22 bp, Artificial Sequence
  Description of Artificial Sequence: Synthetic primer: nbla23754-1r
ggccaacccatattcatcatac

SEQ ID NO: 403 - DNA, 19 bp, Artificial Sequence
  Description of Artificial Sequence: Synthetic primer: nbla23892-1f
gtccttcatacggccaatc

SEQ ID NO: 404 - DNA, 23 bp, Artificial Sequence
  Description of Artificial Sequence: Synthetic primer: nbla23892-1r
cctgtatcattagtccatgctgt

SEQ ID NO: 405 - DNA, 22 bp, Artificial Sequence
  Description of Artificial Sequence: Synthetic primer: nbla23956-1f
cttctaggtgtaggaggtcagg

SEQ ID NO: 406 - DNA, 22 bp, Artificial Sequence
  Description of Artificial Sequence: Synthetic primer: nbla23956-1r
ggagtaggcagtagagcagaga

SEQ ID NO: 407 - DNA, 21 bp, Artificial Sequence
  Description of Artificial Sequence: Synthetic primer: nbla20365r1-1f
tcagaggggacttcttgattt

SEQ ID NO: 408 - DNA, 24 bp, Artificial Sequence
  Description of Artificial Sequence: Synthetic primer: nbla20365r1-1r
aggttcttcactagagttggttgt

SEQ ID NO: 409 - DNA, 21 bp, Artificial Sequence
  Description of Artificial Sequence: Synthetic primer: nbla20378-1f
tgtaaacatgcaaagggaagg

SEQ ID NO: 410 - DNA, 22 bp, Artificial Sequence
  Description of Artificial Sequence: Synthetic primer: nbla20378-1r
agttatttgagggagggacaga

SEQ ID NO: 411 - DNA, 19 bp, Artificial Sequence
  Description of Artificial Sequence: Synthetic primer: nbla20511-1f
acctcaaggcatggttgct

SEQ ID NO: 412 - DNA, 22 bp, Artificial Sequence
  Description of Artificial Sequence: Synthetic primer: nbla20511-1r
ctgctgctccaggtatttttgt

SEQ ID NO: 413 - DNA, 25 bp, Artificial Sequence
  Description of Artificial Sequence: Synthetic primer: nbla21039r1-1f
agaagcaataaccagagatacagag

SEQ ID NO: 414 - DNA, 22 bp, Artificial Sequence
  Description of Artificial Sequence: Synthetic primer: nbla21039r1-1r
aagggaggatgagtagaagaca

SEQ ID NO: 415 - DNA, 22 bp, Artificial Sequence
  Description of Artificial Sequence: Synthetic primer: nbla21107r1-1f
cgattttagcagggaataaagg

SEQ ID NO: 416 - DNA, 24 bp, Artificial Sequence
  Description of Artificial Sequence: Synthetic primer: nbla21107r1-1r
ctccaatccaaagatacagaaggt

SEQ ID NO: 417 - DNA, 18 bp, Artificial Sequence
  Description of Artificial Sequence: Synthetic primer: nbla21367-1f
cggcatggaggactagga

SEQ ID NO: 418 - DNA, 20 bp, Artificial Sequence
  Description of Artificial Sequence: Synthetic primer: nbla21367-1r
gccaacagggaggtgattag

SEQ ID NO: 419 - DNA, 24 bp, Artificial Sequence
  Description of Artificial Sequence: Synthetic primer: nbla21790-1f
atttctttgagtatctggggtcgt

SEQ ID NO: 420 - DNA, 24 bp, Artificial Sequence
  Description of Artificial Sequence: Synthetic primer: nbla21790-1r
cacccaccatctagtaccattttc

SEQ ID NO: 421 - DNA, 20 bp, Artificial Sequence
  Description of Artificial Sequence: Synthetic primer: nbla22253-1f
tatgagccagaggaggatgg

SEQ ID NO: 422 - DNA, 21 bp, Artificial Sequence
  Description of Artificial Sequence: Synthetic primer: nbla22253-1r
ggccaaggtaggtctttgatg

SEQ ID NO: 423 - DNA, 20 bp, Artificial Sequence
  Description of Artificial Sequence: Synthetic primer: nbla22355-1f
atgctgaccttccaggctac

SEQ ID NO: 424 - DNA, 20 bp, Artificial Sequence
  Description of Artificial Sequence: Synthetic primer: nbla22355-1r
tgtgtcttcatcctcctcca

SEQ ID NO: 425 - DNA, 18 bp, Artificial Sequence
  Description of Artificial Sequence: Synthetic primer: nbla22832-1f
cggctgcttgaaactcct

SEQ ID NO: 426 - DNA, 19 bp, Artificial Sequence
  Description of Artificial Sequence: Synthetic primer: nbla22832-1r
tcttcccggtgtcttttcc

SEQ ID NO: 427 - DNA, 23 bp, Artificial Sequence
  Description of Artificial Sequence: Synthetic primer: nbla23755-1f
gcctctgatttttagctctcttg

SEQ ID NO: 428 - DNA, 21 bp, Artificial Sequence
  Description of Artificial Sequence: Synthetic primer: nbla23755-1r
tcctgccatcatatcctttct

SEQ ID NO: 429 - DNA, 20 bp, Artificial Sequence
  Description of Artificial Sequence: Synthetic primer: nbla24549-1f
catatcaaggggcttctggt

SEQ ID NO: 430 - DNA, 21 bp, Artificial Sequence
  Description of Artificial Sequence: Synthetic primer: nbla24549-1r
gcattcacagccttcagtttc

SEQ ID NO: 431 - DNA, 22 bp, Artificial Sequence
  Description of Artificial Sequence: Synthetic primer: nbla20084-1f
ggccagtgttctctaccatctc

SEQ ID NO: 432 - DNA, 22 bp, Artificial Sequence
  Description of Artificial Sequence: Synthetic primer: nbla20084-1r
cacacacatacaaaggtcagca

SEQ ID NO: 433 - DNA, 19 bp, Artificial Sequence
  Description of Artificial Sequence: Synthetic primer: nbla21081-1f
tcgaaaaacacggagagca

SEQ ID NO: 434 - DNA, 19 bp, Artificial Sequence
  Description of Artificial Sequence: Synthetic primer: nbla21081-1r
cacagaatcatggcggaac

SEQ ID NO: 435 - DNA, 19 bp, Artificial Sequence
  Description of Artificial Sequence: Synthetic primer: nbla21420-1f
gaagctgggaaatggtgag

SEQ ID NO: 436 - DNA, 20 bp, Artificial Sequence
  Description of Artificial Sequence: Synthetic primer: nbla21420-1r
ggaaatactcatggctgtgg

SEQ ID NO: 437 - DNA, 19 bp, Artificial Sequence
  Description of Artificial Sequence: Synthetic primer: nbla22452-1f
cagtgggagtcaggaagga

SEQ ID NO: 438 - DNA, 19 bp, Artificial Sequence
  Description of Artificial Sequence: Synthetic primer: nbla22452-1r
acacatgcccagaaagcac

SEQ ID NO: 439 - DNA, 22 bp, Artificial Sequence
  Description of Artificial Sequence: Synthetic primer: nbla22595-1f
catgaccttcagatagttaccc

SEQ ID NO: 440 - DNA, 22 bp, Artificial Sequence
  Description of Artificial Sequence: Synthetic primer: nbla22595-1r
attattgggtggtagacagaca

SEQ ID NO: 441 - DNA, 20 bp, Artificial Sequence
  Description of Artificial Sequence: Synthetic primer: nnbla22676-1
gtggtttttggtggttggag

SEQ ID NO: 442 - DNA, 20 bp, Artificial Sequence
  Description of Artificial Sequence: Synthetic primer: nbla22676-1r
tactgtggcaggaaggaagg

SEQ ID NO: 443 - DNA, 22 bp, Artificial Sequence
  Description of Artificial Sequence: Synthetic primer: nbla22909-1f
acacggacattacaaccttaca

SEQ ID NO: 444 - DNA, 22 bp, Artificial Sequence
  Description of Artificial Sequence: Synthetic primer: nbla22909-1r
caccaaagagaactcgataaca

SEQ ID NO: 445 - DNA, 21 bp, Artificial Sequence
  Description of Artificial Sequence: Synthetic primer: nbla24435-1f
tcagcactggatttaggatgg

SEQ ID NO: 446 - DNA, 24 bp, Artificial Sequence
  Description of Artificial Sequence: Synthetic primer: nbla24435-1r
gcagagcagtacattatcaggaag

SEQ ID NO: 447 - DNA, 22 bp, Artificial Sequence
  Description of Artificial Sequence: Synthetic primer: nbla20146-1f
tccattactcaagtcccaaggt

SEQ ID NO: 448 - DNA, 20 bp, Artificial Sequence
  Description of Artificial Sequence: Synthetic primer: nbla20146-1r
agcgaagctgtcctgtgttc

SEQ ID NO: 449 - DNA, 19 bp, Artificial Sequence
  Description of Artificial Sequence: Synthetic primer: nbla20170-1f
gactcgtcgtttcccacct

SEQ ID NO: 450 - DNA, 21 bp, Artificial Sequence
  Description of Artificial Sequence: Synthetic primer: nbla20170-1r
cctaatgcagccactcatacc

SEQ ID NO: 451 - DNA, 22 bp, Artificial Sequence
  Description of Artificial Sequence: Synthetic primer: nbla20216-1f
catctctccattagcccagaag

SEQ ID NO: 452 - DNA, 21 bp, Artificial Sequence
  Description of Artificial Sequence: Synthetic primer: nbla20216-1r
agaagcgaggagtagggtgag

SEQ ID NO: 453 - DNA, 21 bp, Artificial Sequence
  Description of Artificial Sequence: Synthetic primer: nbla20657-1f
gacgacttgactgatgctgtg

SEQ ID NO: 454 - DNA, 23 bp, Artificial Sequence
  Description of Artificial Sequence: Synthetic primer: nbla20657-1r
caaggacacaattaggaggtgag

SEQ ID NO: 455 - DNA, 23 bp, Artificial Sequence
  Description of Artificial Sequence: Synthetic primer: nbla20688-1f
ctgtctgttgactctccaacctc

SEQ ID NO: 456 - DNA, 21 bp, Artificial Sequence
  Description of Artificial Sequence: Synthetic primer: nbla20688-1r
ccttgggcttctttcctatcc

SEQ ID NO: 457 - DNA, 20 bp, Artificial Sequence
  Description of Artificial Sequence: Synthetic primer: nbla20755-1f
ggatggcagaagcatcaaag

SEQ ID NO: 458 - DNA, 20 bp, Artificial Sequence
  Description of Artificial Sequence: Synthetic primer: nbla20755-1r
agggtttgtgggggatagag

SEQ ID NO: 459 - DNA, 20 bp, Artificial Sequence
  Description of Artificial Sequence: Synthetic primer: nbla21013-1f
tggctgataatgcaatggtg

SEQ ID NO: 460 - DNA, 20 bp, Artificial Sequence
  Description of Artificial Sequence: Synthetic primer: nbla21013-1r
gacctttttggcttctgtgg

SEQ ID NO: 461 - DNA, 22 bp, Artificial Sequence
  Description of Artificial Sequence: Synthetic primer: nbla21172-1f
aatgctatgttcagcagggtgt

SEQ ID NO: 462 - DNA, 18 bp, Artificial Sequence
  Description of Artificial Sequence: Synthetic primer: nbla21172-1r
tgcacttgcgtgatgtgg

SEQ ID NO: 463 - DNA, 21 bp, Artificial Sequence
  Description of Artificial Sequence: Synthetic primer: nbla21200-1f
accatgaggaaaacaactgga

SEQ ID NO: 464 - DNA, 24 bp, Artificial Sequence
  Description of Artificial Sequence: Synthetic primer: nbla21200-1r
aatgtcccgactctattatctgtg

SEQ ID NO: 465 - DNA, 20 bp, Artificial Sequence
  Description of Artificial Sequence: Synthetic primer: nbla21255-1f
cctgaagcccctgtgtatct

SEQ ID NO: 466 - DNA, 20 bp, Artificial Sequence
  Description of Artificial Sequence: Synthetic primer: nbla21255-1r
ccaaaagccaaattctctcc

SEQ ID NO: 467 - DNA, 19 bp, Artificial Sequence
  Description of Artificial Sequence: Synthetic primer: nbla21345-1f
gtgcaaaccccctctaaac

SEQ ID NO: 468 - DNA, 20 bp, Artificial Sequence
  Description of Artificial Sequence: Synthetic primer: nbla21345-1r
tgaccagatgaaacctctcc

SEQ ID NO: 469 - DNA, 20 bp, Artificial Sequence
  Description of Artificial Sequence: Synthetic primer: nbla21410-1f
cctaaacaccaaagggaagg

SEQ ID NO: 470 - DNA, 25 bp, Artificial Sequence
  Description of Artificial Sequence: Synthetic primer: nbla21410-1r
ctccatctctatcttctaaacagca

SEQ ID NO: 471 - DNA, 22 bp, Artificial Sequence
  Description of Artificial Sequence: Synthetic primer: nbla21522-1f
ttgatgtgcggactcttaatct

SEQ ID NO: 472 - DNA, 21 bp, Artificial Sequence
  Description of Artificial Sequence: Synthetic primer: nbla21522-1r
aggtgggtattggctttctct

SEQ ID NO: 473 - DNA, 20 bp, Artificial Sequence
  Description of Artificial Sequence: Synthetic primer: nbla21631-1f
actttctggggtttctctgg

SEQ ID NO: 474 - DNA, 21 bp, Artificial Sequence
  Description of Artificial Sequence: Synthetic primer: nbla21631-1r
gcctctgtaaaatgtggaatg

SEQ ID NO: 475 - DNA, 20 bp, Artificial Sequence
  Description of Artificial Sequence: Synthetic primer: nbla21788-1f
actcccaaacagtccccttc

SEQ ID NO: 476 - DNA, 19 bp, Artificial Sequence
  Description of Artificial Sequence: Synthetic primer: nbla21788-1r
tcctggctttctccagtcc

SEQ ID NO: 477 - DNA, 22 bp, Artificial Sequence
  Description of Artificial Sequence: Synthetic primer: nbla21897-1f
caacagtgaagttgggaaaaca

SEQ ID NO: 478 - DNA, 22 bp, Artificial Sequence
  Description of Artificial Sequence: Synthetic primer: nbla21897-1r
ggctctggttagaagacaaagg

SEQ ID NO: 479 - DNA, 19 bp, Artificial Sequence
  Description of Artificial Sequence: Synthetic primer: nbla22116-1f
catccccggttgaatctct

SEQ ID NO: 480 - DNA, 21 bp, Artificial Sequence
  Description of Artificial Sequence: Synthetic primer: nbla22116-1r
tcccagtccacatgcaaatac

SEQ ID NO: 481 - DNA, 20 bp, Artificial Sequence
  Description of Artificial Sequence: Synthetic primer: nbla22223-1f
cattctttggggcctctttc

SEQ ID NO: 482 - DNA, 19 bp, Artificial Sequence
  Description of Artificial Sequence: Synthetic primer: nbla22223-1r
tggggatcttatggcacct

SEQ ID NO: 483 - DNA, 20 bp, Artificial Sequence
  Description of Artificial Sequence: Synthetic primer: nbla22344-1f
gtctgaaggaacaggggaga

SEQ ID NO: 484 - DNA, 21 bp, Artificial Sequence
  Description of Artificial Sequence: Synthetic primer: nbla22344-1r
gtctaatgggcaaggaaggag

SEQ ID NO: 485 - DNA, 20 bp, Artificial Sequence
  Description of Artificial Sequence: Synthetic primer: nbla22939-1f
gcaccattctctggtttcct

SEQ ID NO: 486 - DNA, 21 bp, Artificial Sequence
  Description of Artificial Sequence: Synthetic primer: nbla22939-1r
cacacctccatactccatgct

SEQ ID NO: 487 - DNA, 22 bp, Artificial Sequence
  Description of Artificial Sequence: Synthetic primer: nbla23084-1f
gcactcgatgactaccaaaaag

SEQ ID NO: 488 - DNA, 24 bp, Artificial Sequence
  Description of Artificial Sequence: Synthetic primer: nbla23084-1r
ggataatgagtaggttggctaatg

SEQ ID NO: 489 - DNA, 18 bp, Artificial Sequence
  Description of Artificial Sequence: Synthetic primer: nbla23103-1f
agacggcttttgcgtttg

SEQ ID NO: 490 - DNA, 20 bp, Artificial Sequence
  Description of Artificial Sequence: Synthetic primer: nbla23103-1r
agaagttagggctgggaagg

SEQ ID NO: 491 - DNA, 18 bp, Artificial Sequence
  Description of Artificial Sequence: Synthetic primer: nbla23234-1f
ccgcatttccaactgacc

SEQ ID NO: 492 - DNA, 20 bp, Artificial Sequence
  Description of Artificial Sequence: Synthetic primer: nbla23234-1r
gatcccacaagtttcccaca

SEQ ID NO: 493 - DNA, 20 bp, Artificial Sequence
  Description of Artificial Sequence: Synthetic primer: nbla23369-1f
agccccaaatgagaaatcaa

SEQ ID NO: 494 - DNA, 21 bp, Artificial Sequence
  Description of Artificial Sequence: Synthetic primer: nbla23369-1r
ggagctggagtgataagcaga

SEQ ID NO: 495 - DNA, 21 bp, Artificial Sequence
  Description of Artificial Sequence: Synthetic primer: nbla23436-1f
cctagaatagctggggagtgg

SEQ ID NO: 496 - DNA, 21 bp, Artificial Sequence
  Description of Artificial Sequence: Synthetic primer: nbla23436-1r
cgagagcgtcaaagatacagg

SEQ ID NO: 497 - DNA, 22 bp, Artificial Sequence
  Description of Artificial Sequence: Synthetic primer: nbla23511-1f
aatcaaggacaaagactcacac

SEQ ID NO: 498 - DNA, 22 bp, Artificial Sequence
  Description of Artificial Sequence: Synthetic primer: nbla23511-1r
agacacagtaaacagggaagga

SEQ ID NO: 499 - DNA, 19 bp, Artificial Sequence
  Description of Artificial Sequence: Synthetic primer: nbla23860-1f
gtcagggaggtcatggaag

SEQ ID NO: 500 - DNA, 22 bp, Artificial Sequence
  Description of Artificial Sequence: Synthetic primer: nbla23860-1r
gctctgataagcaagtggaaga

SEQ ID NO: 501 - DNA, 18 bp, Artificial Sequence
  Description of Artificial Sequence: Synthetic primer: nbla23877-1f
tcctctcaggtgggcttg

SEQ ID NO: 502 - DNA, 20 bp, Artificial Sequence
  Description of Artificial Sequence: Synthetic primer: nbla23877-1r
ctgtgcttggatgctgtagg

SEQ ID NO: 503 - DNA, 23 bp, Artificial Sequence
  Description of Artificial Sequence: Synthetic primer: nbla23998-1f
ctgtatcctgctgttcatggtag

SEQ ID NO: 504 - DNA, 21 bp, Artificial Sequence
  Description of Artificial Sequence: Synthetic primer: nbla23998-1r
agcaaaaagtcgtagcttggt

SEQ ID NO: 505 - DNA, 22 bp, Artificial Sequence
  Description of Artificial Sequence: Synthetic primer: nbla24043-1-1f
agatggtgatctggaacatgaa

SEQ ID NO: 506 - DNA, 21 bp, Artificial Sequence
  Description of Artificial Sequence: Synthetic primer: nbla24043-1-1r
cctattgacccagcaagaaac

SEQ ID NO: 507 - DNA, 21 bp, Artificial Sequence
  Description of Artificial Sequence: Synthetic primer: nbla24402-1f
tgttatgggcacttgaatggt

SEQ ID NO: 508 - DNA, 20 bp, Artificial Sequence
  Description of Artificial Sequence: Synthetic primer: nbla24402-1r
tgcagaaaggcagtttgttg

SEQ ID NO: 509 - DNA, 21 bp, Artificial Sequence
  Description of Artificial Sequence: Synthetic primer: nbla24821-1f
tccctaaagtgattggctggt

SEQ ID NO: 510 - DNA, 20 bp, Artificial Sequence
  Description of Artificial Sequence: Synthetic primer: nbla24821-1r
gattggcacaggttttgagg

SEQ ID NO: 511 - DNA, 20 bp, Artificial Sequence
  Description of Artificial Sequence: Synthetic primer: nbla20026-1f
atcaaatgtgctggttgtgg

SEQ ID NO: 512 - DNA, 19 bp, Artificial Sequence
  Description of Artificial Sequence: Synthetic primer: nbla20026-1r
caagcatctgtgggaagga

SEQ ID NO: 513 - DNA, 20 bp, Artificial Sequence
  Description of Artificial Sequence: Synthetic primer: nbla20421-1f
tgcaacatttcgttttcctc

SEQ ID NO: 514 - DNA, 23 bp, Artificial Sequence
  Description of Artificial Sequence: Synthetic primer: nbla20421-1r
gctgttcctgagtctttgcttac

SEQ ID NO: 515 - DNA, 22 bp, Artificial Sequence
  Description of Artificial Sequence: Synthetic primer: nbla22298-1f
ccaactatggactatcgggttc

SEQ ID NO: 516 - DNA, 20 bp, Artificial Sequence
  Description of Artificial Sequence: Synthetic primer: nbla22298-1r
gtctttcctggggtcttgct

SEQ ID NO: 517 - DNA, 20 bp, Artificial Sequence
  Description of Artificial Sequence: Synthetic primer: nbla22549-1f
atctttcccactccaccaca

SEQ ID NO: 518 - DNA, 20 bp, Artificial Sequence
  Description of Artificial Sequence: Synthetic primer: nbla22549-1r
gacaagttcggggagacaac

SEQ ID NO: 519 - DNA, 20 bp, Artificial Sequence
  Description of Artificial Sequence: Synthetic primer: nbla22256-1f
gcagccctcttcgtagttcc

SEQ ID NO: 520 - DNA, 19 bp, Artificial Sequence
  Description of Artificial Sequence: Synthetic primer: nbla22256-1r
ctcgccctggtctctgtct

SEQ ID NO: 521 - DNA, 20 bp, Artificial Sequence
  Description of Artificial Sequence: Synthetic primer: nbla22968-1f
cagtgcatttgggagatgtg

SEQ ID NO: 522 - DNA, 20 bp, Artificial Sequence
  Description of Artificial Sequence: Synthetic primer: nbla22968-1r
ctcaaaacgccaggaaagag

SEQ ID NO: 523 - DNA, 20 bp, Artificial Sequence
  Description of Artificial Sequence: Synthetic primer: nbla24079-1f
gcctactggaaaagccactc

SEQ ID NO: 524 - DNA, 19 bp, Artificial Sequence
  Description of Artificial Sequence: Synthetic primer: nbla24079-1r
ctgtgtgcaaatccctgct

SEQ ID NO: 525 - DNA, 19 bp, Artificial Sequence
  Description of Artificial Sequence: Synthetic primer: nbla20211-1f
acaacatgggcaaccacct

SEQ ID NO: 526 - DNA, 20 bp, Artificial Sequence
  Description of Artificial Sequence: Synthetic primer: nbla20211-1r
gtcgtcatcgtgcaaagtcc

SEQ ID NO: 527 - DNA, 21 bp, Artificial Sequence
  Description of Artificial Sequence: Synthetic primer: nbla20469-1f
gctcttcacctcaaatgctct

SEQ ID NO: 528 - DNA, 22 bp, Artificial Sequence
  Description of Artificial Sequence: Synthetic primer: nbla20469-1r
gagttagtcctgctcatggttc

SEQ ID NO: 529 - DNA, 20 bp, Artificial Sequence
  Description of Artificial Sequence: Synthetic primer: nbla21250-1f
tcgcctctgcactagctctc

SEQ ID NO: 530 - DNA, 21 bp, Artificial Sequence
  Description of Artificial Sequence: Synthetic primer: nbla21250-1r
gtgtaaacccacatgcctcct

SEQ ID NO: 531 - DNA, 18 bp, Artificial Sequence
  Description of Artificial Sequence: Synthetic primer: nbla22761-1f
gatgagaacgccaaagca

SEQ ID NO: 532 - DNA, 19 bp, Artificial Sequence
  Description of Artificial Sequence: Synthetic primer: nbla22761-1r
aattcggtccaactcagca

SEQ ID NO: 533 - DNA, 20 bp, Artificial Sequence
  Description of Artificial Sequence: Synthetic primer: nbla23631-1f
gcctagagcaatgtcgtgaa

SEQ ID NO: 534 - DNA, 21 bp, Artificial Sequence
  Description of Artificial Sequence: Synthetic primer: nbla23631-1r
cgcaggaagataagtgtgagg

SEQ ID NO: 535 - DNA, 22 bp, Artificial Sequence
  Description of Artificial Sequence: Synthetic primer: nbla23711-1f
gaccctagaccacggacattac

SEQ ID NO: 536 - DNA, 18 bp, Artificial Sequence
  Description of Artificial Sequence: Synthetic primer: nbla23711-1r
cgctcaccaccatcaaca

SEQ ID NO: 537 - DNA, 20 bp, Artificial Sequence
  Description of Artificial Sequence: Synthetic primer: nbla24532-1f
agggctcagtcatggatagg

SEQ ID NO: 538 - DNA, 20 bp, Artificial Sequence
  Description of Artificial Sequence: Synthetic primer: nbla24532-1r
gctgggcacacacagtaaag

SEQ ID NO: 539 - DNA, 20 bp, Artificial Sequence
  Description of Artificial Sequence: Synthetic primer: nbla24951-1f
tgttttctgcatcaggcttc

SEQ ID NO: 540 - DNA, 21 bp, Artificial Sequence
  Description of Artificial Sequence: Synthetic primer: nbla24951-1r
catttggttcccacttcttgt

SEQ ID NO: 541 - DNA, 26 bp, Artificial Sequence
  Description of Artificial Sequence: Synthetic primer: nbla24348-1f
gacagagtagaagaggaacatgaaga

SEQ ID NO: 542 - DNA, 21 bp, Artificial Sequence
  Description of Artificial Sequence: Synthetic primer: nbla24348-1r
catcagtttgtgggaaggttg

SEQ ID NO: 543 - DNA, 18 bp, Artificial Sequence
  Description of Artificial Sequence: Synthetic primer: nbla24686-1f
tcgaaaagcctgcggtgt

SEQ ID NO: 544 - DNA, 20 bp, Artificial Sequence
  Description of Artificial Sequence: Synthetic primer: nbla24686-1r
taggcggggctgagtgtatc

SEQ ID NO: 545 - DNA, 20 bp, Artificial Sequence
  Description of Artificial Sequence: Synthetic primer: nbla24756-1f
ttgactgtgcttgagaggtg

SEQ ID NO: 546 - DNA, 20 bp, Artificial Sequence
  Description of Artificial Sequence: Synthetic primer: nbla24756-1r
cttgttggtggagaaactgg

SEQ ID NO: 547 - DNA, 20 bp, Artificial Sequence
  Description of Artificial Sequence: Synthetic primer: nbla24521-1f
gccaaaatgcaaaggagaag

SEQ ID NO: 548 - DNA, 20 bp, Artificial Sequence
  Description of Artificial Sequence: Synthetic primer: nbla24521-1r
tatggtcccaaaggtggatg

SEQ ID NO: 549 - DNA, 20 bp, Artificial Sequence
  Description of Artificial Sequence: Synthetic primer: nbla24526-1f
tgaaatggcagagaatggaa

SEQ ID NO: 550 - DNA, 22 bp, Artificial Sequence
  Description of Artificial Sequence: Synthetic primer: nbla24526-1r
tccagagaaaaatactgcaagg

SEQ ID NO: 551 - DNA, 19 bp, Artificial Sequence
  Description of Artificial Sequence: Synthetic primer: nbla21212-1f
ctggggattttcgttgttg

SEQ ID NO: 552 - DNA, 21 bp, Artificial Sequence
  Description of Artificial Sequence: Synthetic primer: nbla21212-1r
tgtttctgggctgtttatcct

SEQ ID NO: 553 - DNA, 21 bp, Artificial Sequence
  Description of Artificial Sequence: Synthetic primer: nbla20604-1f
atcgtcttcagatggagcttg

SEQ ID NO: 554 - DNA, 19 bp, Artificial Sequence
  Description of Artificial Sequence: Synthetic primer: nbla20604-1r
atgtgacccgacgttgatg

SEQ ID NO: 555 - DNA, 20 bp, Artificial Sequence
  Description of Artificial Sequence: Synthetic primer: nbla21226-1f
gcctcagtggatggtaaatg

SEQ ID NO: 556 - DNA, 20 bp, Artificial Sequence
  Description of Artificial Sequence: Synthetic primer: nbla21226-1r
ccaagaagcagaaaagcaag

SEQ ID NO: 557 - DNA, 20 bp, Artificial Sequence
  Description of Artificial Sequence: Synthetic primer: nbla21928-1f
ctcaggttttctgcatagtt

SEQ ID NO: 558 - DNA, 20 bp, Artificial Sequence
  Description of Artificial Sequence: Synthetic primer: nbla21928-1r
tgatagtttccaaggtaagg

SEQ ID NO: 559 - DNA, 24 bp, Artificial Sequence
  Description of Artificial Sequence: Synthetic primer: nbla22643-1f
ctggtttatattggatgagagtgg

SEQ ID NO: 560 - DNA, 22 bp, Artificial Sequence
  Description of Artificial Sequence: Synthetic primer: nbla22643-1r
agatgaaatggaagctcacaag

SEQ ID NO: 561 - DNA, 20 bp, Artificial Sequence
  Description of Artificial Sequence: Synthetic primer: nbla23649-1f
tgtatccagttgcccaaggt

SEQ ID NO: 562 - DNA, 21 bp, Artificial Sequence
  Description of Artificial Sequence: Synthetic primer: nbla23649-1r
cacagcagaagccaaagaaag

SEQ ID NO: 563 - DNA, 20 bp, Artificial Sequence
  Description of Artificial Sequence: Synthetic primer: nbla24468-1f
cgacacaggttctgcttcct

SEQ ID NO: 564 - DNA, 20 bp, Artificial Sequence
  Description of Artificial Sequence: Synthetic primer: nbla24468-1r
gccttctctcctccatcctt

SEQ ID NO: 565 - DNA, 23 bp, Artificial Sequence
  Description of Artificial Sequence: Synthetic primer: nbla20874r1-1f
acccagctcttatcccttaatct

SEQ ID NO: 566 - DNA, 21 bp, Artificial Sequence
  Description of Artificial Sequence: Synthetic primer: nbla20874r1-1r
gccttcacaacaaagttctcc

SEQ ID NO: 567 - DNA, 20 bp, Artificial Sequence
  Description of Artificial Sequence: Synthetic primer: nbla20134-1f
gtaactagggggccacattc

SEQ ID NO: 568 - DNA, 20 bp, Artificial Sequence
  Description of Artificial Sequence: Synthetic primer: nbla20134-1r
gacaacacgtctgcaccttc

SEQ ID NO: 569 - DNA, 22 bp, Artificial Sequence
  Description of Artificial Sequence: Synthetic primer: nbla20181-1f
cgtgtaaagaaacccaaaggag

SEQ ID NO: 570 - DNA, 20 bp, Artificial Sequence
  Description of Artificial Sequence: Synthetic primer: nbla20181-1r
tctacccagcggagtttgag

SEQ ID NO: 571 - DNA, 22 bp, Artificial Sequence
  Description of Artificial Sequence: Synthetic primer: nbla20276-1f
ctatctcccaggattttgctct

SEQ ID NO: 572 - DNA, 19 bp, Artificial Sequence
  Description of Artificial Sequence: Synthetic primer: nbla20276-1r
ccaggaagctggaacctct

SEQ ID NO: 573 - DNA, 21 bp, Artificial Sequence
  Description of Artificial Sequence: Synthetic primer: nbla20709-1f
gattagttgggacctgccttg

SEQ ID NO: 574 - DNA, 20 bp, Artificial Sequence
  Description of Artificial Sequence: Synthetic primer: nbla20709-1r
caatgctttttcggaggaga

SEQ ID NO: 575 - DNA, 23 bp, Artificial Sequence
  Description of Artificial Sequence: Synthetic primer: nbla20782-1f
caaagatgggaacaaccagtatc

SEQ ID NO: 576 - DNA, 24 bp, Artificial Sequence
  Description of Artificial Sequence: Synthetic primer: nbla20782-1r
actgtctatgaagtaaggcaagca

SEQ ID NO: 577 - DNA, 21 bp, Artificial Sequence
  Description of Artificial Sequence: Synthetic primer: nbla20788-1f
ctggactcaggagaggagaca

SEQ ID NO: 578 - DNA, 19 bp, Artificial Sequence
  Description of Artificial Sequence: Synthetic primer: nbla20788-1r
gaaagccacccaaaccaag

SEQ ID NO: 579 - DNA, 21 bp, Artificial Sequence
  Description of Artificial Sequence: Synthetic primer: nbla21046-1f
tcttggaggtgtgcagagatg

SEQ ID NO: 580 - DNA, 20 bp, Artificial Sequence
  Description of Artificial Sequence: Synthetic primer: nbla21046-1r
tctgtttcgggctggtagtg

SEQ ID NO: 581 - DNA, 24 bp, Artificial Sequence
  Description of Artificial Sequence: Synthetic primer: nbla21122-1f
ctagaagctccatattccctcttc

SEQ ID NO: 582 - DNA, 21 bp, Artificial Sequence
  Description of Artificial Sequence: Synthetic primer: nbla21122-1r
ggttaagaacgtgatgcctgt

SEQ ID NO: 583 - DNA, 20 bp, Artificial Sequence
  Description of Artificial Sequence: Synthetic primer: nbla21211r1-1f
cttcagctcctttcccaatc

SEQ ID NO: 584 - DNA, 20 bp, Artificial Sequence
  Description of Artificial Sequence: Synthetic primer: nbla21211r1-1f
accatgtcttgtggtggtgt

SEQ ID NO: 585 - DNA, 19 bp, Artificial Sequence
  Description of Artificial Sequence: Synthetic primer: nbla21233d-1f
atggggaatggtctgcttc

SEQ ID NO: 586 - DNA, 21 bp, Artificial Sequence
  Description of Artificial Sequence: Synthetic primer: nbla21233d-1r
ctccctcttccaaggatgtct

SEQ ID NO: 587 - DNA, 21 bp, Artificial Sequence
  Description of Artificial Sequence: Synthetic primer: nbla21375-1f
ctttgccatcctgaaagagag

SEQ ID NO: 588 - DNA, 20 bp, Artificial Sequence
  Description of Artificial Sequence: Synthetic primer: nbla21375-1r
gtagcagacgatgtggtgga

SEQ ID NO: 589 - DNA, 20 bp, Artificial Sequence
  Description of Artificial Sequence: Synthetic primer: nbla21524-1f
cctcgaaagatccctgattg

SEQ ID NO: 590 - DNA, 21 bp, Artificial Sequence
  Description of Artificial Sequence: Synthetic primer: nbla21524-1r
tcccagctccagaacttacct

SEQ ID NO: 591 - DNA, 20 bp, Artificial Sequence
  Description of Artificial Sequence: Synthetic primer: nbla21843-1f
ccatattgggagacaccatc

SEQ ID NO: 592 - DNA, 18 bp, Artificial Sequence
  Description of Artificial Sequence: Synthetic primer: nbla21843-1r
atcctgaccctgcacctt

SEQ ID NO: 593 - DNA, 21 bp, Artificial Sequence
  Description of Artificial Sequence: Synthetic primer: nbla21934-1f
gattttcaggtgggagatttg

SEQ ID NO: 594 - DNA, 20 bp, Artificial Sequence
  Description of Artificial Sequence: Synthetic primer: nbla21934-1r
tctgttttgtgcctttttgg

SEQ ID NO: 595 - DNA, 23 bp, Artificial Sequence
  Description of Artificial Sequence: Synthetic primer: nbla22153-1f
gctgctgaagaaatagtggattg

SEQ ID NO: 596 - DNA, 20 bp, Artificial Sequence
  Description of Artificial Sequence: Synthetic primer: nbla22153-1r
acgataggtggcattgaggt

SEQ ID NO: 597 - DNA, 25 bp, Artificial Sequence
  Description of Artificial Sequence: Synthetic primer: nbla22382-1f
gtgcctgtgatattgagtttaagga

SEQ ID NO: 598 - DNA, 24 bp, Artificial Sequence
  Description of Artificial Sequence: Synthetic primer: nbla22382-1r
tagtggagatgggactacaaaagg

SEQ ID NO: 599 - DNA, 18 bp, Artificial Sequence
  Description of Artificial Sequence: Synthetic primer: nbla22571-1f
gtcatagtgcccaccaca

SEQ ID NO: 600 - DNA, 18 bp, Artificial Sequence
  Description of Artificial Sequence: Synthetic primer: nbla22571-1r
ttgcacaggagaaatgga

SEQ ID NO: 601 - DNA, 20 bp, Artificial Sequence
  Description of Artificial Sequence: Synthetic primer: nbla22789-1f
gctaaggggatgaagcaaac

SEQ ID NO: 602 - DNA, 19 bp, Artificial Sequence
  Description of Artificial Sequence: Synthetic primer: nbla22789-1r
agcagagccactccacaga

SEQ ID NO: 603 - DNA, 20 bp, Artificial Sequence
  Description of Artificial Sequence: Synthetic primer: nbla23060-1f
catgcgggagagagaatgag

SEQ ID NO: 604 - DNA, 22 bp, Artificial Sequence
  Description of Artificial Sequence: Synthetic primer: nbla23060-1r
tcacctttaggcaatgaagagg

SEQ ID NO: 605 - DNA, 21 bp, Artificial Sequence
  Description of Artificial Sequence: Synthetic primer: nbla23218-1f
ccttgactctctctccccttc

SEQ ID NO: 606 - DNA, 18 bp, Artificial Sequence
  Description of Artificial Sequence: Synthetic primer: nbla23218-1r
gacacggttctgcctgct

SEQ ID NO: 607 - DNA, 20 bp, Artificial Sequence
  Description of Artificial Sequence: Synthetic primer: nbla23545-1f
cattcactcctttggcctct

SEQ ID NO: 608 - DNA, 20 bp, Artificial Sequence
  Description of Artificial Sequence: Synthetic primer: nbla23545-1r
agcctcatgttcgcatttct

SEQ ID NO: 609 - DNA, 21 bp, Artificial Sequence
  Description of Artificial Sequence: Synthetic primer: nbla23653-1f
acccaaagctagggaatcaac

SEQ ID NO: 610 - DNA, 19 bp, Artificial Sequence
  Description of Artificial Sequence: Synthetic primer: nbla23653-1r
tcagaaacacggccaaaac

SEQ ID NO: 611 - DNA, 20 bp, Artificial Sequence
  Description of Artificial Sequence: Synthetic primer: nbla23666-1f
cgtggtggtgtgtattttgg

SEQ ID NO: 612 - DNA, 21 bp, Artificial Sequence
  Description of Artificial Sequence: Synthetic primer: nbla23666-1r
gtatcgcggtgacataaaagg

SEQ ID NO: 613 - DNA, 20 bp, Artificial Sequence
  Description of Artificial Sequence: Synthetic primer: nbla23760-1f
attgaggcgaaagtcaaacc

SEQ ID NO: 614 - DNA, 21 bp, Artificial Sequence
  Description of Artificial Sequence: Synthetic primer: nbla23760-1r
acaggactgaaagaaccagca

SEQ ID NO: 615 - DNA, 21 bp, Artificial Sequence
  Description of Artificial Sequence: Synthetic primer: nbla23830-1f
tatagtgacgggagggacaga

SEQ ID NO: 616 - DNA, 19 bp, Artificial Sequence
  Description of Artificial Sequence: Synthetic primer: nbla23830-1r
cggatggaagtcatggaag

SEQ ID NO: 617 - DNA, 21 bp, Artificial Sequence
  Description of Artificial Sequence: Synthetic primer: nbla23942-1f
cgaagaagagccagaatgaga

SEQ ID NO: 618 - DNA, 20 bp, Artificial Sequence
  Description of Artificial Sequence: Synthetic primer: nbla23942-1r
tggggaaagattttgtgagg

SEQ ID NO: 619 - DNA, 21 bp, Artificial Sequence
  Description of Artificial Sequence: Synthetic primer: nbla24131-1f
ggcacataaccagtttccaag

SEQ ID NO: 620 - DNA, 21 bp, Artificial Sequence
  Description of Artificial Sequence: Synthetic primer: nbla24131-1r
gccaccaaaatgtagcaaaag

SEQ ID NO: 621 - DNA, 18 bp, Artificial Sequence
  Description of Artificial Sequence: Synthetic primer: nbla24908-1f
acaaggccatcctgcaac

SEQ ID NO: 622 - DNA, 20 bp, Artificial Sequence
  Description of Artificial Sequence: Synthetic primer: nbla24908-1r
ctgatctggttctccgtcct

SEQ ID NO: 623 - DNA, 21 bp, Artificial Sequence
  Description of Artificial Sequence: Synthetic primer: nbla20125-1f
tctcccttcgccttcttctac

SEQ ID NO: 624 - DNA, 20 bp, Artificial Sequence
  Description of Artificial Sequence: Synthetic primer: nbla20125-1r
actggttccgatgtgttgct

SEQ ID NO: 625 - DNA, 20 bp, Artificial Sequence
  Description of Artificial Sequence: Synthetic primer: nbla20231d-1f
tagggtgctggatggtagag

SEQ ID NO: 626 - DNA, 20 bp, Artificial Sequence
  Description of Artificial Sequence: Synthetic primer: nbla20231-1r
catcaacttctgcaaggaca

SEQ ID NO: 627 - DNA, 20 bp, Artificial Sequence
  Description of Artificial Sequence: Synthetic primer: nbla20268-1f
atcaggacagatggggaaca

SEQ ID NO: 628 - DNA, 23 bp, Artificial Sequence
  Description of Artificial Sequence: Synthetic primer: nbla20268-1r
tcagagagaaggatttggatgag

SEQ ID NO: 629 - DNA, 22 bp, Artificial Sequence
  Description of Artificial Sequence: Synthetic primer: nbla20395-1f
tttcctgagtgtgtgagatgaa

SEQ ID NO: 630 - DNA, 19 bp, Artificial Sequence
  Description of Artificial Sequence: Synthetic primer: nbla20395-1r
taggccagggacagaaatg

SEQ ID NO: 631 - DNA, 20 bp, Artificial Sequence
  Description of Artificial Sequence: Synthetic primer: nbla23973-1f
agaaaagaaacggcaacgag

SEQ ID NO: 632 - DNA, 20 bp, Artificial Sequence
  Description of Artificial Sequence: Synthetic primer: nbla23973-1r
ggtgggtgagaagatgatgg

SEQ ID NO: 633 - DNA, 21 bp, Artificial Sequence
  Description of Artificial Sequence: Synthetic primer: nbla24041-1f
cagtaaaggcaagggaagagg

SEQ ID NO: 634 - DNA, 22 bp, Artificial Sequence
  Description of Artificial Sequence: Synthetic primer: nbla24041-1r
cttgggaaacaaaagtccagag

SEQ ID NO: 635 - DNA, 20 bp, Artificial Sequence
  Description of Artificial Sequence: Synthetic primer: nbla24082-1f
cgcaatactcatttgctgtg

SEQ ID NO: 636 - DNA, 24 bp, Artificial Sequence
  Description of Artificial Sequence: Synthetic primer: nbla24082-1r
tgtagacttctggtaacaatctgg

SEQ ID NO: 637 - DNA, 21 bp, Artificial Sequence
  Description of Artificial Sequence: Synthetic primer: nbla24239-1f
gaaggaattgagagcacagca

SEQ ID NO: 638 - DNA, 19 bp, Artificial Sequence
  Description of Artificial Sequence: Synthetic primer: nbla24239-1r
atccctgcatcaccacctc

SEQ ID NO: 639 - DNA, 25 bp, Artificial Sequence
  Description of Artificial Sequence: Synthetic primer: nbla20638-1f
gtctgtcaacaaatacaccaaaacc

SEQ ID NO: 640 - DNA, 20 bp, Artificial Sequence
  Description of Artificial Sequence: Synthetic primer: nbla20638-1r
ttatccaactccccaaagca

SEQ ID NO: 641 - DNA, 21 bp, Artificial Sequence
  Description of Artificial Sequence: Synthetic primer: nbla20765-1f
tgaaagcgtctgttgttaccc

SEQ ID NO: 642 - DNA, 23 bp, Artificial Sequence
  Description of Artificial Sequence: Synthetic primer: nbla20765-1r
tgtcggaactcatctacctcaac

SEQ ID NO: 643 - DNA, 21 bp, Artificial Sequence
  Description of Artificial Sequence: Synthetic primer: nbla20789-1f
tgtcctgcttcttgtttgtgg

SEQ ID NO: 644 - DNA, 20 bp, Artificial Sequence
  Description of Artificial Sequence: Synthetic primer: nbla20789-1r
ggcgctccttgtgtagtgaa

SEQ ID NO: 645 - DNA, 21 bp, Artificial Sequence
  Description of Artificial Sequence: Synthetic primer: nbla20792-1f
ctttgtacccctgcctaatcc

SEQ ID NO: 646 - DNA, 20 bp, Artificial Sequence
  Description of Artificial Sequence: Synthetic primer: nbla20792-1r
aatacccaacccacccttgt

SEQ ID NO: 647 - DNA, 19 bp, Artificial Sequence
  Description of Artificial Sequence: Synthetic primer: nbla20798-1f
gctgcctcagaacatttgg

SEQ ID NO: 648 - DNA, 20 bp, Artificial Sequence
  Description of Artificial Sequence: Synthetic primer: nbla20798-1r
ggccctccaccataaataga

SEQ ID NO: 649 - DNA, 20 bp, Artificial Sequence
  Description of Artificial Sequence: Synthetic primer: nbla21024-1f
tgccacatacatggaacacc

SEQ ID NO: 650 - DNA, 21 bp, Artificial Sequence
  Description of Artificial Sequence: Synthetic primer: nbla21024-1r
catgctacacgggacctactc

SEQ ID NO: 651 - DNA, 20 bp, Artificial Sequence
  Description of Artificial Sequence: Synthetic primer: nbla24363-1f
caaatggttgctggtctcct

SEQ ID NO: 652 - DNA, 22 bp, Artificial Sequence
  Description of Artificial Sequence: Synthetic primer: nbla24363-1r
cttccctcctcttgctacctct

SEQ ID NO: 653 - DNA, 19 bp, Artificial Sequence
  Description of Artificial Sequence: Synthetic primer: nbla24622-1f
tgccagggaacagagagtg

SEQ ID NO: 654 - DNA, 22 bp, Artificial Sequence
  Description of Artificial Sequence: Synthetic primer: nbla24622-1r
tgtaaaagggacctgagaggag

SEQ ID NO: 655 - DNA, 20 bp, Artificial Sequence
  Description of Artificial Sequence: Synthetic primer: nbla24646-1f
tgcaggcgtacaactaacaa

SEQ ID NO: 656 - DNA, 20 bp, Artificial Sequence
  Description of Artificial Sequence: Synthetic primer: nbla24646-1r
tggtctgcgagaaatcaaac

SEQ ID NO: 657 - DNA, 20 bp, Artificial Sequence
  Description of Artificial Sequence: Synthetic primer: nbla24672-1f
ccagcctctgtggtctttgt

SEQ ID NO: 658 - DNA, 19 bp, Artificial Sequence
  Description of Artificial Sequence: Synthetic primer: nbla24672-1r
cacctaacgccacgtcttc

SEQ ID NO: 659 - DNA, 21 bp, Artificial Sequence
  Description of Artificial Sequence: Synthetic primer: nbla21077-1f
tgaaggatgtaccccagagag

SEQ ID NO: 660 - DNA, 20 bp, Artificial Sequence
  Description of Artificial Sequence: Synthetic primer: nbla21077-1r
gataaggccacagcaaaagg

SEQ ID NO: 661 - DNA, 22 bp, Artificial Sequence
  Description of Artificial Sequence: Synthetic primer: nbla21089-1f
cacgctcaagttcattagcaca

SEQ ID NO: 662 - DNA, 20 bp, Artificial Sequence
  Description of Artificial Sequence: Synthetic primer: nbla21089-1r
tgtccaatcaccgcagtttc

SEQ ID NO: 663 - DNA, 21 bp, Artificial Sequence
  Description of Artificial Sequence: Synthetic primer: nbla21130-1f
agcttgacctctccagaacac

SEQ ID NO: 664 - DNA, 24 bp, Artificial Sequence
  Description of Artificial Sequence: Synthetic primer: nbla21130-1r
ggttgtctctttaattgtcccttc

SEQ ID NO: 665 - DNA, 22 bp, Artificial Sequence
  Description of Artificial Sequence: Synthetic primer: nbla21266-1f
gacagagtgctcagattgttgg

SEQ ID NO: 666 - DNA, 20 bp, Artificial Sequence
  Description of Artificial Sequence: Synthetic primer: nbla21266-1r
cctagaggaaggtgggctgt

SEQ ID NO: 667 - DNA, 20 bp, Artificial Sequence
  Description of Artificial Sequence: Synthetic primer: nbla24709-1f
cagcctcccaactcattttc

SEQ ID NO: 668 - DNA, 18 bp, Artificial Sequence
  Description of Artificial Sequence: Synthetic primer: nbla24709-1r
tgggctccttctgcaatc

SEQ ID NO: 669 - DNA, 20 bp, Artificial Sequence
  Description of Artificial Sequence: Synthetic primer: nbla24748-1f
cggtttgccctgtttttatg

SEQ ID NO: 670 - DNA, 27 bp, Artificial Sequence
  Description of Artificial Sequence: Synthetic primer: nbla24748-1r
gctcaactactatcttgggatctcttt

SEQ ID NO: 671 - DNA, 22 bp, Artificial Sequence
  Description of Artificial Sequence: Synthetic primer: nbla24831-1f
gcagtttcttcatcaaaggtgt

SEQ ID NO: 672 - DNA, 22 bp, Artificial Sequence
  Description of Artificial Sequence: Synthetic primer: nbla24831-1r
tctatcccatgtgttgtgtttg

SEQ ID NO: 673 - DNA, 22 bp, Artificial Sequence
  Description of Artificial Sequence: Synthetic primer: nbla24972-1f
ggtattttcaaccaccaggaac

SEQ ID NO: 674 - DNA, 22 bp, Artificial Sequence
  Description of Artificial Sequence: Synthetic primer: nbla24972-1r
aggatagcaccattcatcacct

SEQ ID NO: 675 - DNA, 20 bp, Artificial Sequence
  Description of Artificial Sequence: Synthetic primer: nbla21413-1f
tgctggggagtatgaagaca

SEQ ID NO: 676 - DNA, 21 bp, Artificial Sequence
  Description of Artificial Sequence: Synthetic primer: nbla21413-1r
ctttatttgcagccattccac

SEQ ID NO: 677 - DNA, 22 bp, Artificial Sequence
  Description of Artificial Sequence: Synthetic primer: nbla21520-1f
tggaacctacgtctttccctac

SEQ ID NO: 678 - DNA, 20 bp, Artificial Sequence
  Description of Artificial Sequence: Synthetic primer: nbla21520-1r
acagctcatgtctgcctcct

SEQ ID NO: 679 - DNA, 24 bp, Artificial Sequence
  Description of Artificial Sequence: Synthetic primer: nbla21936-1f
ccacaggaagctatcaaagaaaag

SEQ ID NO: 680 - DNA, 22 bp, Artificial Sequence
  Description of Artificial Sequence: Synthetic primer: nbla21936-1r
tacactggtggagaggaacaga

SEQ ID NO: 681 - DNA, 21 bp, Artificial Sequence
  Description of Artificial Sequence: Synthetic primer: nbla22028-1f
tgtagggaccagaacacgaga

SEQ ID NO: 682 - DNA, 20 bp, Artificial Sequence
  Description of Artificial Sequence: Synthetic primer: nbla22028-1r
cagaagcagagacccttcca

SEQ ID NO: 683 - DNA, 22 bp, Artificial Sequence
  Description of Artificial Sequence: Synthetic primer: nbla22093-1d-1f
agacactatcacgagacccaga

SEQ ID NO: 684 - DNA, 22 bp, Artificial Sequence
  Description of Artificial Sequence: Synthetic primer: nbla22093-1d-1r
agacactatcacgagacccaga

SEQ ID NO: 685 - DNA, 22 bp, Artificial Sequence
  Description of Artificial Sequence: Synthetic primer: nbla22218-1f
ggctcaggaagagaagaagatg

SEQ ID NO: 686 - DNA, 20 bp, Artificial Sequence
  Description of Artificial Sequence: Synthetic primer: nbla22218-1r
atccaaaaggggccatagag

SEQ ID NO: 687 - DNA, 23 bp, Artificial Sequence
  Description of Artificial Sequence: Synthetic primer: nbla22451-1f
tcctcaataataagcctgtgtcc

SEQ ID NO: 688 - DNA, 20 bp, Artificial Sequence
  Description of Artificial Sequence: Synthetic primer: nbla22451-1r
tccctgtgtttgcttttcac

SEQ ID NO: 689 - DNA, 21 bp, Artificial Sequence
  Description of Artificial Sequence: Synthetic primer: nbla22455d-1f
caatggtggaaaccagtaagg

SEQ ID NO: 690 - DNA, 20 bp, Artificial Sequence
  Description of Artificial Sequence: Synthetic primer: nbla22455d-1r
agtttggggaacagtgcaag

SEQ ID NO: 691 - DNA, 20 bp, Artificial Sequence
  Description of Artificial Sequence: Synthetic primer: nbla22464-1f
ggacaaggcagaggtgaatg

SEQ ID NO: 692 - DNA, 20 bp, Artificial Sequence
  Description of Artificial Sequence: Synthetic primer: nbla22464-1r
cgtgtaaggacggtgattgg

SEQ ID NO: 693 - DNA, 22 bp, Artificial Sequence
  Description of Artificial Sequence: Synthetic primer: nbla22465-1f
gtcactttgcttttgctcgtct

SEQ ID NO: 694 - DNA, 20 bp, Artificial Sequence
  Description of Artificial Sequence: Synthetic primer: nbla22465-1r
tgggaacttgaaccaccatc

SEQ ID NO: 695 - DNA, 18 bp, Artificial Sequence
  Description of Artificial Sequence: Synthetic primer: nbla22487-1f
aacgcctcgtcctgctct

SEQ ID NO: 696 - DNA, 18 bp, Artificial Sequence
  Description of Artificial Sequence: Synthetic primer: nbla22487-1r
ccggtgggctaaaatggt

SEQ ID NO: 697 - DNA, 19 bp, Artificial Sequence
  Description of Artificial Sequence: Synthetic primer: nbla22669-1f
ccgaggaagaagagcaagg

SEQ ID NO: 698 - DNA, 18 bp, Artificial Sequence
  Description of Artificial Sequence: Synthetic primer: nbla22669-1r
ccaagcagatggcacaca

SEQ ID NO: 699 - DNA, 19 bp, Artificial Sequence
  Description of Artificial Sequence: Synthetic primer: nbla22726-1f
gcccagcaacaagacagag

SEQ ID NO: 700 - DNA, 19 bp, Artificial Sequence
  Description of Artificial Sequence: Synthetic primer: nbla22726-1r
ctgcaaaatgggagactgg

SEQ ID NO: 701 - DNA, 20 bp, Artificial Sequence
  Description of Artificial Sequence: Synthetic primer: nbla22886-1f
gcacagggaaccatcagaac

SEQ ID NO: 702 - DNA, 20 bp, Artificial Sequence
  Description of Artificial Sequence: Synthetic primer: nbla22886-1r
caccaccaacgtcattcctc

SEQ ID NO: 703 - DNA, 20 bp, Artificial Sequence
  Description of Artificial Sequence: Synthetic primer: nbla23012-1f
aggagaaacaggagcgagag

SEQ ID NO: 704 - DNA, 18 bp, Artificial Sequence
  Description of Artificial Sequence: Synthetic primer: nbla23012-1r
ttgctgagatgcgtggag

SEQ ID NO: 705 - DNA, 20 bp, Artificial Sequence
  Description of Artificial Sequence: Synthetic primer: nbla23038-1f
gaaacctcagcatggagaca

SEQ ID NO: 706 - DNA, 23 bp, Artificial Sequence
  Description of Artificial Sequence: Synthetic primer: nbla23038-1r
ccaatcactcactcacaaaagag

SEQ ID NO: 707 - DNA, 20 bp, Artificial Sequence
  Description of Artificial Sequence: Synthetic primer: nbla23718-1f
atggaaaacttgcctgctct

SEQ ID NO: 708 - DNA, 22 bp, Artificial Sequence
  Description of Artificial Sequence: Synthetic primer: nbla23718-1r
tcacccacactttatctccaac

SEQ ID NO: 709 - DNA, 22 bp, Artificial Sequence
  Description of Artificial Sequence: Synthetic primer: nbla23719-1f
ctgaacagaaaagcacaacctc

SEQ ID NO: 710 - DNA, 20 bp, Artificial Sequence
  Description of Artificial Sequence: Synthetic primer: nbla23719-1r
acaggcgggtcaaatctatc

SEQ ID NO: 711 - DNA, 20 bp, Artificial Sequence
  Description of Artificial Sequence: Synthetic primer: nbla23951-1f
cctgctgttctggttccttg

SEQ ID NO: 712 - DNA, 20 bp, Artificial Sequence
  Description of Artificial Sequence: Synthetic primer: nbla23951-1r
agcctgggtctttcatctgg

SEQ ID NO: 713 - DNA, 20 bp, Artificial Sequence
  Description of Artificial Sequence: Synthetic primer: nbla21855-1f
atgaagggggaaggggttct

SEQ ID NO: 714 - DNA, 21 bp, Artificial Sequence
  Description of Artificial Sequence: Synthetic primer: nbla21855-1r
gaacatggtgctcctttgtgg

SEQ ID NO: 715 - DNA, 19 bp, Artificial Sequence
  Description of Artificial Sequence: Synthetic primer: nbla22704-1f
tcacaaatcagcaggcaca

SEQ ID NO: 716 - DNA, 21 bp, Artificial Sequence
  Description of Artificial Sequence: Synthetic primer: nbla22704-1r
tgctaccaacccctctacatc

SEQ ID NO: 717 - DNA, 21 bp, Artificial Sequence
  Description of Artificial Sequence: Synthetic primer: nbla23394-1f
ttcctgagagactgggagttg

SEQ ID NO: 718 - DNA, 19 bp, Artificial Sequence
  Description of Artificial Sequence: Synthetic primer: nbla23394-1r
atagctgagggagccgttg

SEQ ID NO: 719 - DNA, 21 bp, Artificial Sequence
  Description of Artificial Sequence: Synthetic primer: nbla23512-1f
actgtcccaccacaactgaac

SEQ ID NO: 720 - DNA, 23 bp, Artificial Sequence
  Description of Artificial Sequence: Synthetic primer: nbla23512-1r
ctcataatctcgtctttgcacct

SEQ ID NO: 721 - DNA, 22 bp, Artificial Sequence
  Description of Artificial Sequence: Synthetic primer: nbla24084-1f
ttagcagagacatgcaacaaca

SEQ ID NO: 722 - DNA, 22 bp, Artificial Sequence
  Description of Artificial Sequence: Synthetic primer: nbla24084-1r
cgtgatccaacagaagattgag

SEQ ID NO: 723 - DNA, 21 bp, Artificial Sequence
  Description of Artificial Sequence: Synthetic primer: nbla24376-1f
aacaagcctagaggaatgaac

SEQ ID NO: 724 - DNA, 18 bp, Artificial Sequence
  Description of Artificial Sequence: Synthetic primer: nbla24376-1r
tacaagaagcgcaacacc

SEQ ID NO: 725 - DNA, 20 bp, Artificial Sequence
  Description of Artificial Sequence: Synthetic primer: nbla21761-1f
cttcgccagacaaaaccatc

SEQ ID NO: 726 - DNA, 21 bp, Artificial Sequence
  Description of Artificial Sequence: Synthetic primer: nbla21761-1r
gatctcccccttcttctcctc

SEQ ID NO: 727 - DNA, 20 bp, Artificial Sequence
  Description of Artificial Sequence: Synthetic primer: nbla23456-1f
ccattgctttagtcgttgct

SEQ ID NO: 728 - DNA, 20 bp, Artificial Sequence
  Description of Artificial Sequence: Synthetic primer: nbla23456-1r
aattagctcctcctcgctgt

SEQ ID NO: 729 - DNA, 22 bp, Artificial Sequence
  Description of Artificial Sequence: Synthetic primer: nbla24297-1f
acaaccattccctaactccatc

SEQ ID NO: 730 - DNA, 21 bp, Artificial Sequence
  Description of Artificial Sequence: Synthetic primer: nbla24297-1r
ctgttactgttgctgcttcca

SEQ ID NO: 731 - DNA, 19 bp, Artificial Sequence
  Description of Artificial Sequence: Synthetic primer: nbla24719-1f
tcgttacaccgctttgtcc

SEQ ID NO: 732 - DNA, 20 bp, Artificial Sequence
  Description of Artificial Sequence: Synthetic primer: nbla24719-1r
ggcttggaaaacacacacac

SEQ ID NO: 733 - DNA, 20 bp, Artificial Sequence
  Description of Artificial Sequence: Synthetic primer: nbla20113-1f
gcccaaagggtatttccaag

SEQ ID NO: 734 - DNA, 19 bp, Artificial Sequence
  Description of Artificial Sequence: Synthetic primer: nbla20113-1r
cacaaggggtggactgatg

SEQ ID NO: 735 - DNA, 19 bp, Artificial Sequence
  Description of Artificial Sequence: Synthetic primer: nbla20253r1-1f
accagggataagggggaac

SEQ ID NO: 736 - DNA, 20 bp, Artificial Sequence
  Description of Artificial Sequence: Synthetic primer: nbla20253r1-1r
tgctttgcccacactaaaga

SEQ ID NO: 737 - DNA, 19 bp, Artificial Sequence
  Description of Artificial Sequence: Synthetic primer: nbla20549-1f
gtgcttgtctgatgggatg

SEQ ID NO: 738 - DNA, 19 bp, Artificial Sequence
  Description of Artificial Sequence: Synthetic primer: nbla20549-1r
caatgaagacgctcacagg

SEQ ID NO: 739 - DNA, 21 bp, Artificial Sequence
  Description of Artificial Sequence: Synthetic primer: nbla20835-1f
aaggtgacagcataggtggag

SEQ ID NO: 740 - DNA, 23 bp, Artificial Sequence
  Description of Artificial Sequence: Synthetic primer: nbla20835-1r
tgatagggattcttgctaactgg

SEQ ID NO: 741 - DNA, 18 bp, Artificial Sequence
  Description of Artificial Sequence: Synthetic primer: nbla20968-1f
agcctggtggctcacatc

SEQ ID NO: 742 - DNA, 22 bp, Artificial Sequence
  Description of Artificial Sequence: Synthetic primer: nbla20968-1r
gacacttgcctcaatagggttc

SEQ ID NO: 743 - DNA, 25 bp, Artificial Sequence
  Description of Artificial Sequence: Synthetic primer: nbla21087-1f
gtgtctctcctagtgattgattttg

SEQ ID NO: 744 - DNA, 22 bp, Artificial Sequence
  Description of Artificial Sequence: Synthetic primer: nbla21087-1r
taaaaggggttgttctcttgct

SEQ ID NO: 745 - DNA, 19 bp, Artificial Sequence
  Description of Artificial Sequence: Synthetic primer: nbla21189-1f
catcctacaggtggaagca

SEQ ID NO: 746 - DNA, 20 bp, Artificial Sequence
  Description of Artificial Sequence: Synthetic primer: nbla21189-1r
agttcttgggtgtggtgaag

SEQ ID NO: 747 - DNA, 20 bp, Artificial Sequence
  Description of Artificial Sequence: Synthetic primer: nbla21214-1f
aggggtaagtcagggaagga

SEQ ID NO: 748 - DNA, 20 bp, Artificial Sequence
  Description of Artificial Sequence: Synthetic primer: nbla21214-1r
cctaccaggcaaagtccaag

SEQ ID NO: 749 - DNA, 20 bp, Artificial Sequence
  Description of Artificial Sequence: Synthetic primer: nbla21337-1f
atttcagccgcatctcacac

SEQ ID NO: 750 - DNA, 21 bp, Artificial Sequence
  Description of Artificial Sequence: Synthetic primer: nbla21337-1r
gcttcgccaacactcattaca

SEQ ID NO: 751 - DNA, 22 bp, Artificial Sequence
  Description of Artificial Sequence: Synthetic primer: nbla21344r1-1f
ccattttgctgattttctctgg

SEQ ID NO: 752 - DNA, 20 bp, Artificial Sequence
  Description of Artificial Sequence: Synthetic primer: nbla21344r1-1r
attcttccccctccctctgt

SEQ ID NO: 753 - DNA, 19 bp, Artificial Sequence
  Description of Artificial Sequence: Synthetic primer: nbla21956-2-1f
ggacttggggctctcctct

SEQ ID NO: 754 - DNA, 20 bp, Artificial Sequence
  Description of Artificial Sequence: Synthetic primer: nbla21956-2-1r
gctagggcacctgatttgtg

SEQ ID NO: 755 - DNA, 20 bp, Artificial Sequence
  Description of Artificial Sequence: Synthetic primer: nbla22228-1f
gtatgttggagcagcgaaag

SEQ ID NO: 756 - DNA, 20 bp, Artificial Sequence
  Description of Artificial Sequence: Synthetic primer: nbla22228-1r
gtccccaaagaagagttcca

SEQ ID NO: 757 - DNA, 22 bp, Artificial Sequence
  Description of Artificial Sequence: Synthetic primer: nbla22351-1f
ggtgagttagctttgaggtgtg

SEQ ID NO: 758 - DNA, 20 bp, Artificial Sequence
  Description of Artificial Sequence: Synthetic primer: nbla22351-1r
ggccagacgagtggaaatag

SEQ ID NO: 759 - DNA, 20 bp, Artificial Sequence
  Description of Artificial Sequence: Synthetic primer: nbla22361-1f
ccctacggatcaagggctac

SEQ ID NO: 760 - DNA, 19 bp, Artificial Sequence
  Description of Artificial Sequence: Synthetic primer: nbla22361-1r
ctgtctcaggggctccaac

SEQ ID NO: 761 - DNA, 20 bp, Artificial Sequence
  Description of Artificial Sequence: Synthetic primer: nbla22474-1f
gaagatgctgccctaattcc

SEQ ID NO: 762 - DNA, 21 bp, Artificial Sequence
  Description of Artificial Sequence: Synthetic primer: nbla22474-1r
ccacattccttttctttgtcc

SEQ ID NO: 763 - DNA, 21 bp, Artificial Sequence
  Description of Artificial Sequence: Synthetic primer: nbla22939-1f
ggacagcagcaactcaaaaag

SEQ ID NO: 764 - DNA, 20 bp, Artificial Sequence
  Description of Artificial Sequence: Synthetic primer: nbla22939-1r
tatctatccccatgcctcca

SEQ ID NO: 765 - DNA, 20 bp, Artificial Sequence
  Description of Artificial Sequence: Synthetic primer: nbla23775-1f
tgagcaataccctgcctaca

SEQ ID NO: 766 - DNA, 22 bp, Artificial Sequence
  Description of Artificial Sequence: Synthetic primer: nbla23775-1r
gtccccagtgctaatcctactc

SEQ ID NO: 767 - DNA, 18 bp, Artificial Sequence
  Description of Artificial Sequence: Synthetic primer: nbla24182-1f
ctgacgggagaggaggaa

SEQ ID NO: 768 - DNA, 20 bp, Artificial Sequence
  Description of Artificial Sequence: Synthetic primer: nbla24182-1r
gaaaaggcaccgaacagaac

SEQ ID NO: 769 - DNA, 20 bp, Artificial Sequence
  Description of Artificial Sequence: Synthetic primer: nbla24285-1f
tcagacggtgaggatgatgt

SEQ ID NO: 770 - DNA, 18 bp, Artificial Sequence
  Description of Artificial Sequence: Synthetic primer: nbla24285-1r
cgctgtccttttgcctgt

SEQ ID NO: 771 - DNA, 20 bp, Artificial Sequence
  Description of Artificial Sequence: Synthetic primer: nbla24434-1f
cagaggctgagaatggtgtg

SEQ ID NO: 772 - DNA, 20 bp, Artificial Sequence
  Description of Artificial Sequence: Synthetic primer: nbla24434-1r
gccttgtactggctggaaga

SEQ ID NO: 773 - DNA, 21 bp, Artificial Sequence
  Description of Artificial Sequence: Synthetic primer: nbla24460d-1f
tctctgaaaagtgccagtcca

SEQ ID NO: 774 - DNA, 20 bp, Artificial Sequence
  Description of Artificial Sequence: Synthetic primer: nbla24460d-1r
tcatgccctgccttagaaac

SEQ ID NO: 775 - DNA, 25 bp, Artificial Sequence
  Description of Artificial Sequence: Synthetic primer: nbla24762-1f
agctactctgaagacctccctatgt

SEQ ID NO: 776 - DNA, 20 bp, Artificial Sequence
  Description of Artificial Sequence: Synthetic primer: nbla24762-1r
tgcatccacacgttctcttg

SEQ ID NO: 777 - DNA, 20 bp, Artificial Sequence
  Description of Artificial Sequence: Synthetic primer: nbla24893-1f
agatggatttttgccccttc

SEQ ID NO: 778 - DNA, 22 bp, Artificial Sequence
  Description of Artificial Sequence: Synthetic primer: nbla24893-1r
tacaggtagaaacaagcccaca

SEQ ID NO: 779 - DNA, 18 bp, Artificial Sequence
  Description of Artificial Sequence: Synthetic primer: nbla24973-1f
tccctggaggcaaacaca

SEQ ID NO: 780 - DNA, 20 bp, Artificial Sequence
  Description of Artificial Sequence: Synthetic primer: nbla24973-1r
atgtgacgcagtggcctatc

SEQ ID NO: 781 - DNA, 19 bp, Artificial Sequence
  Description of Artificial Sequence: Synthetic primer: nbla24986-1-1f
atggaacaccacagccaga

SEQ ID NO: 782 - DNA, 21 bp, Artificial Sequence
  Description of Artificial Sequence: Synthetic primer: nbla24986-1-1r
ccagagtcagcccattaaaca

SEQ ID NO: 783 - DNA, 21 bp, Artificial Sequence
  Description of Artificial Sequence: Synthetic primer: nbla23020-1f
tcaggatgaggaaatgacagg

SEQ ID NO: 784 - DNA, 19 bp, Artificial Sequence
  Description of Artificial Sequence: Synthetic primer: nbla23020-1r
agtcacgctgggaggaaag

SEQ ID NO: 785 - DNA, 20 bp, Artificial Sequence
  Description of Artificial Sequence: Synthetic primer: nbla20087d-1f(k)
ccagctctccagttttcagg

SEQ ID NO: 786 - DNA, 21 bp, Artificial Sequence
  Description of Artificial Sequence: Synthetic primer: nbla20087d-1r
gttccctttcggtagttgagg

SEQ ID NO: 787 - DNA, 22 bp, Artificial Sequence
  Description of Artificial Sequence: Synthetic primer: nbla21750d-1f(k)
gatgaattgcctccattgtctc

SEQ ID NO: 788 - DNA, 20 bp, Artificial Sequence
  Description of Artificial Sequence: Synthetic primer: nbla21750d-1r
ggtttgctgcttctggatgt

SEQ ID NO: 789 - DNA, 21 bp, Artificial Sequence
  Description of Artificial Sequence: Synthetic primer: nbla22129-1f(k)
cagatggggagtgttctgatg

SEQ ID NO: 790 - DNA, 21 bp, Artificial Sequence
  Description of Artificial Sequence: Synthetic primer: nbla22129-1r
tctagggggtggtaaagatgg

SEQ ID NO: 791 - DNA, 22 bp, Artificial Sequence
  Description of Artificial Sequence: Synthetic primer: nbla22808-1f(k)
ggaccaagatatggttttggag

SEQ ID NO: 792 - DNA, 20 bp, Artificial Sequence
  Description of Artificial Sequence: Synthetic primer: nbla22808-1r
gcatgtatttgcctcccttg

SEQ ID NO: 793 - DNA, 21 bp, Artificial Sequence
  Description of Artificial Sequence: Synthetic primer: nbla23064-1f(k)
catgaacccttccctatgtcc

SEQ ID NO: 794 - DNA, 19 bp, Artificial Sequence
  Description of Artificial Sequence: Synthetic primer: nbla23064-1r
tctttgcatccatcgcatc

SEQ ID NO: 795 - DNA, 19 bp, Artificial Sequence
  Description of Artificial Sequence: Synthetic primer: nbla23358d-1f(k)
gctctcccaaatcgcctac

SEQ ID NO: 796 - DNA, 19 bp, Artificial Sequence
  Description of Artificial Sequence: Synthetic primer: nbla23358-d-1r
cctcatcatccccttccac

SEQ ID NO: 797 - DNA, 20 bp, Artificial Sequence
  Description of Artificial Sequence: Synthetic primer: nbla22443-1f(k)
atccttggtggccttgtatg

SEQ ID NO: 798 - DNA, 20 bp, Artificial Sequence
  Description of Artificial Sequence: Synthetic primer: nbla22443-1r
tcagagtgattgctggcttg

SEQ ID NO: 799 - DNA, 22 bp, Artificial Sequence
  Description of Artificial Sequence: Synthetic primer: nbla20235-1f(k)
tccttacacgggccataaatac

SEQ ID NO: 800 - DNA, 20 bp, Artificial Sequence
  Description of Artificial Sequence: Synthetic primer: nbla20235-1r
accgtctcaaatcgaaccac

SEQ ID NO: 801 - DNA, 19 bp, Artificial Sequence
  Description of Artificial Sequence: Synthetic primer: nbla22607-1f(k)
acacatgcctagcagacca

SEQ ID NO: 802 - DNA, 22 bp, Artificial Sequence
  Description of Artificial Sequence: Synthetic primer: nbla22607-1r
tgcacttcatttagacttcacc

SEQ ID NO: 803 - DNA, 19 bp, Artificial Sequence
  Description of Artificial Sequence: Synthetic primer: nbla22305-1f(k)
gcagttccaatgaaggaca

SEQ ID NO: 804 - DNA, 22 bp, Artificial Sequence
  Description of Artificial Sequence: Synthetic primer: nbla22305-1r
tcatctgcttggtgtatgaaag

SEQ ID NO: 805 - DNA, 21 bp, Artificial Sequence
  Description of Artificial Sequence: Synthetic primer: nbla22031-1f(k)
tccctctgtattttgggttgg

SEQ ID NO: 806 - DNA, 20 bp, Artificial Sequence
  Description of Artificial Sequence: Synthetic primer: nbla22031-1r
ggtggatgttccttgagtgg

SEQ ID NO: 807 - DNA, 20 bp, Artificial Sequence
  Description of Artificial Sequence: Synthetic primer: nbla23478d-1f(k)
agcacaacagcaaggacaga

SEQ ID NO: 808 - DNA, 19 bp, Artificial Sequence
  Description of Artificial Sequence: Synthetic primer: nbla23478d-1r
cgttaccaaacagcccaga

SEQ ID NO: 809 - DNA, 20 bp, Artificial Sequence
  Description of Artificial Sequence: Synthetic primer: nbla23896-1f(k)
tcccattacaggctctttcc

SEQ ID NO: 810 - DNA, 22 bp, Artificial Sequence
  Description of Artificial Sequence: Synthetic primer: nbla23896-1r
gctccttccaagatttatccac

SEQ ID NO: 811 - DNA, 19 bp, Artificial Sequence
  Description of Artificial Sequence: Synthetic primer: nbla24920-1f(k)
gcaactccatccaccgtct

SEQ ID NO: 812 - DNA, 19 bp, Artificial Sequence
  Description of Artificial Sequence: Synthetic primer: nbla24920-1r
ccgtttctgggctctcttg

SEQ ID NO: 813 - DNA, 24 bp, Artificial Sequence
  Description of Artificial Sequence: Synthetic primer: nbla20141-1f(k)
ctgtgttaccctgtttttctacct

SEQ ID NO: 814 - DNA, 23 bp, Artificial Sequence
  Description of Artificial Sequence: Synthetic primer: nbla20141-1r
cgggctatgtatctaaggttttc

SEQ ID NO: 815 - DNA, 20 bp, Artificial Sequence
  Description of Artificial Sequence: Synthetic primer: nbla20446-1f(k)
tagccctctttggtcctcct

SEQ ID NO: 816 - DNA, 22 bp, Artificial Sequence
  Description of Artificial Sequence: Synthetic primer: nbla20446-1r
ttacagtcatgttgccagttcc

SEQ ID NO: 817 - DNA, 22 bp, Artificial Sequence
  Description of Artificial Sequence: Synthetic primer: nbla21538-1f(k)
ggagagaagtttgaagaaacca

SEQ ID NO: 818 - DNA, 20 bp, Artificial Sequence
  Description of Artificial Sequence: Synthetic primer: nbla21538-1r
tccaccactaatttcccatc

SEQ ID NO: 819 - DNA, 18 bp, Artificial Sequence
  Description of Artificial Sequence: Synthetic primer: nbla22558-1f(k)
cgggccaccagtttctct

SEQ ID NO: 820 - DNA, 19 bp, Artificial Sequence
  Description of Artificial Sequence: Synthetic primer: nbla22558-1r
tcgatactcggcctcgaac

SEQ ID NO: 821 - DNA, 20 bp, Artificial Sequence
  Description of Artificial Sequence: Synthetic primer: nbla21623-1f(k)
ggaagaaaagttccgaggtg

SEQ ID NO: 822 - DNA, 19 bp, Artificial Sequence
  Description of Artificial Sequence: Synthetic primer: nbla21623-1r
ttgacagtgctgcttgtgg

SEQ ID NO: 823 - DNA, 21 bp, Artificial Sequence
  Description of Artificial Sequence: Synthetic primer: nbla21969-1f(k)
caaaagcgtcctgctctacac

SEQ ID NO: 824 - DNA, 19 bp, Artificial Sequence
  Description of Artificial Sequence: Synthetic primer: nbla21969-1r
acgagactgaccacccaga

SEQ ID NO: 825 - DNA, 21 bp, Artificial Sequence
  Description of Artificial Sequence: Synthetic primer: nbla22219-1f(k)
tgtggttcatagtgaggtgga

SEQ ID NO: 826 - DNA, 20 bp, Artificial Sequence
  Description of Artificial Sequence: Synthetic primer: nbla22219-1r
gagcaagttttggctttgtg

SEQ ID NO: 827 - DNA, 21 bp, Artificial Sequence
  Description of Artificial Sequence: Synthetic primer: nbla23272-1f(k)
ctagggacaggaagatggttg

SEQ ID NO: 828 - DNA, 20 bp, Artificial Sequence
  Description of Artificial Sequence: Synthetic primer: nbla23272-1r
gatacaggtcatgggcagag

SEQ ID NO: 829 - DNA, 19 bp, Artificial Sequence
  Description of Artificial Sequence: Synthetic primer: nbla23307-1-1f(k)
atccctcagaacccatgct

SEQ ID NO: 830 - DNA, 20 bp, Artificial Sequence
  Description of Artificial Sequence: Synthetic primer: nbla23307-1-1r
cgctcaacttccacttctcc

SEQ ID NO: 831 - DNA, 20 bp, Artificial Sequence
  Description of Artificial Sequence: Synthetic primer: nbla24117-1f(k)
gtcctgaaggcagagggaag

SEQ ID NO: 832 - DNA, 20 bp, Artificial Sequence
  Description of Artificial Sequence: Synthetic primer: nbla24117-1r
cagggttggggtaagagagg

SEQ ID NO: 833 - DNA, 19 bp, Artificial Sequence
  Description of Artificial Sequence: Synthetic primer: nbla23262-1f(k)
ggacaagagccaggaagaa

SEQ ID NO: 834 - DNA, 21 bp, Artificial Sequence
  Description of Artificial Sequence: Synthetic primer: nbla23262-1r
ggtggaaaggtttggagtatg

SEQ ID NO: 835 - DNA, 21 bp, Artificial Sequence
  Description of Artificial Sequence: Synthetic primer: nbla20133d-1f(k)
gctacgtggaagtgaatggag

SEQ ID NO: 836 - DNA, 20 bp, Artificial Sequence
  Description of Artificial Sequence: Synthetic primer: nbla20133d-1r
ccagaaacagaccccaagag

SEQ ID NO: 837 - DNA, 18 bp, Artificial Sequence
  Description of Artificial Sequence: Synthetic primer: nbla20263r1-1f(k)
tgggggaaaagttcttgg

SEQ ID NO: 838 - DNA, 19 bp, Artificial Sequence
  Description of Artificial Sequence: Synthetic primer: nbla20263r1-1r
gcctgtcctgtagctggtt

SEQ ID NO: 839 - DNA, 18 bp, Artificial Sequence
  Description of Artificial Sequence: Synthetic primer: nbla20723-1f(k)
agatgccaaacgcagaac

SEQ ID NO: 840 - DNA, 20 bp, Artificial Sequence
  Description of Artificial Sequence: Synthetic primer: nbla20723-1r
ttgaagcaaacactcaccaa

SEQ ID NO: 841 - DNA, 20 bp, Artificial Sequence
  Description of Artificial Sequence: Synthetic primer: nbla20748-1f(k)
catccatctcacagcaccac

SEQ ID NO: 842 - DNA, 20 bp, Artificial Sequence
  Description of Artificial Sequence: Synthetic primer: nbla20748-1r
tctcacgcagcaactcaatc

SEQ ID NO: 843 - DNA, 21 bp, Artificial Sequence
  Description of Artificial Sequence: Synthetic primer: nbla20915-1f(k)
ggatcagagagggctaccttg

SEQ ID NO: 844 - DNA, 20 bp, Artificial Sequence
  Description of Artificial Sequence: Synthetic primer: nbla20915-1r
cctgctgtttggtcgtagtg

SEQ ID NO: 845 - DNA, 21 bp, Artificial Sequence
  Description of Artificial Sequence: Synthetic primer: nbla21016-1f(k)
agtttactcttgcccactcca

SEQ ID NO: 846 - DNA, 20 bp, Artificial Sequence
  Description of Artificial Sequence: Synthetic primer: nbla21016-1r
ctggatttttgccctgtctc

SEQ ID NO: 847 - DNA, 20 bp, Artificial Sequence
  Description of Artificial Sequence: Synthetic primer: nbla21034r1-1f(k)
caatcaccagttgctgtcct

SEQ ID NO: 848 - DNA, 21 bp, Artificial Sequence
  Description of Artificial Sequence: Synthetic primer: nbla21034r1-1r
atttcccagtctcccctatgt

SEQ ID NO: 849 - DNA, 20 bp, Artificial Sequence
  Description of Artificial Sequence: Synthetic primer: nbla21067-1f(k)
tgagaagaggagtgcaagga

SEQ ID NO: 850 - DNA, 18 bp, Artificial Sequence
  Description of Artificial Sequence: Synthetic primer: nbla21067-1r
tgcatggatttgggtttg

SEQ ID NO: 851 - DNA, 20 bp, Artificial Sequence
  Description of Artificial Sequence: Synthetic primer: nbla21167-1f(k)
ttcttctctgtccccaaaca

SEQ ID NO: 852 - DNA, 22 bp, Artificial Sequence
  Description of Artificial Sequence: Synthetic primer: nbla21167-1r
gagctgtcaatacaacactgga

SEQ ID NO: 853 - DNA, 19 bp, Artificial Sequence
  Description of Artificial Sequence: Synthetic primer: nbla21319-1f(k)
ttggggttcatcctccttc

SEQ ID NO: 854 - DNA, 20 bp, Artificial Sequence
  Description of Artificial Sequence: Synthetic primer: nbla21319-1r
gttgaggtcgttctccgtgt

SEQ ID NO: 855 - DNA, 23 bp, Artificial Sequence
  Description of Artificial Sequence: Synthetic primer: nbla21331-1f(k)
tggcaggttttcttctacttgtg

SEQ ID NO: 856 - DNA, 22 bp, Artificial Sequence
  Description of Artificial Sequence: Synthetic primer: nbla21331-1r
tcccagctaacatggttgattt

SEQ ID NO: 857 - DNA, 20 bp, Artificial Sequence
  Description of Artificial Sequence: Synthetic primer: nbla21516-1f(k)
gcaggaagcgatggttaaga

SEQ ID NO: 858 - DNA, 21 bp, Artificial Sequence
  Description of Artificial Sequence: Synthetic primer: nbla21516-1r
gcccaagtaggaatctgtgtg

SEQ ID NO: 859 - DNA, 20 bp, Artificial Sequence
  Description of Artificial Sequence: Synthetic primer: nbla21682d-1f(k)
aatctacgcttcccaaacca

SEQ ID NO: 860 - DNA, 20 bp, Artificial Sequence
  Description of Artificial Sequence: Synthetic primer: nbla21682-1r
taggcactgggcaatgatac

SEQ ID NO: 861 - DNA, 18 bp, Artificial Sequence
  Description of Artificial Sequence: Synthetic primer: nbla21691-1f(k)
gcaggtgaatgccttggt

SEQ ID NO: 862 - DNA, 19 bp, Artificial Sequence
  Description of Artificial Sequence: Synthetic primer: nbla21691-1r
gcacgaattgcttggagag

SEQ ID NO: 863 - DNA, 21 bp, Artificial Sequence
  Description of Artificial Sequence: Synthetic primer: nbla21822-1f(k)
gcagaggatggaaagttgatg

SEQ ID NO: 864 - DNA, 20 bp, Artificial Sequence
  Description of Artificial Sequence: Synthetic primer: nbla21822-1r
gtggcagcacaaagaaaaga

SEQ ID NO: 865 - DNA, 19 bp, Artificial Sequence
  Description of Artificial Sequence: Synthetic primer: nbla21976-2-1f(k)
agtgctgggcctaaaggag

SEQ ID NO: 866 - DNA, 22 bp, Artificial Sequence
  Description of Artificial Sequence: Synthetic primer: nbla21976-2-1r
gactccctgactgttgatgttg

SEQ ID NO: 867 - DNA, 22 bp, Artificial Sequence
  Description of Artificial Sequence: Synthetic primer: nbla21977-1f(k)
gcctaccatttcacagaggttt

SEQ ID NO: 868 - DNA, 22 bp, Artificial Sequence
  Description of Artificial Sequence: Synthetic primer: nbla21977-1r
tgtttttatatgctgcccttcc

SEQ ID NO: 869 - DNA, 20 bp, Artificial Sequence
  Description of Artificial Sequence: Synthetic primer: nbla22159-1f(k)
tggcacatcagaaaggaatg

SEQ ID NO: 870 - DNA, 20 bp, Artificial Sequence
  Description of Artificial Sequence: Synthetic primer: nbla22159-1r
aatgggagccaaggaaagag

SEQ ID NO: 871 - DNA, 20 bp, Artificial Sequence
  Description of Artificial Sequence: Synthetic primer: nbla22168-1f(k)
tactgggtcgggtgtttgtg

SEQ ID NO: 872 - DNA, 19 bp, Artificial Sequence
  Description of Artificial Sequence: Synthetic primer: nbla22168-1r
ccgatggtgctcttgctct

SEQ ID NO: 873 - DNA, 21 bp, Artificial Sequence
  Description of Artificial Sequence: Synthetic primer: nbla22215-1-1f(k)
gccctctcctgacttgtattg

SEQ ID NO: 874 - DNA, 21 bp, Artificial Sequence
  Description of Artificial Sequence: Synthetic primer: nbla22215-1-1r
cctgaagtttgctgttttgtg

SEQ ID NO: 875 - DNA, 22 bp, Artificial Sequence
  Description of Artificial Sequence: Synthetic primer: nbla22244-1f(k)
agagaatcggaagtggatgaga

SEQ ID NO: 876 - DNA, 19 bp, Artificial Sequence
  Description of Artificial Sequence: Synthetic primer: nbla22244-1r
atgcttgctgctttgcttg

SEQ ID NO: 877 - DNA, 20 bp, Artificial Sequence
  Description of Artificial Sequence: Synthetic primer: nbla22263-1f(k)
aagattggaagacccgtttg

SEQ ID NO: 878 - DNA, 20 bp, Artificial Sequence
  Description of Artificial Sequence: Synthetic primer: nbla22263-1r
acagcttttggggtgatttg

SEQ ID NO: 879 - DNA, 19 bp, Artificial Sequence
  Description of Artificial Sequence: Synthetic primer: nbla22548-1f(k)
atcccaaccacctcccttg

SEQ ID NO: 880 - DNA, 20 bp, Artificial Sequence
  Description of Artificial Sequence: Synthetic primer: nbla22548-1r
ctgctgtccccactcctctt

SEQ ID NO: 881 - DNA, 20 bp, Artificial Sequence
  Description of Artificial Sequence: Synthetic primer: nbla23033-1f(k)
tctagtggtggcagggaaga

SEQ ID NO: 882 - DNA, 21 bp, Artificial Sequence
  Description of Artificial Sequence: Synthetic primer: nbla23033-1r
agcatggaggaaacagacaga

SEQ ID NO: 883 - DNA, 20 bp, Artificial Sequence
  Description of Artificial Sequence: Synthetic primer: nbla23231-1f(k)
aggctctccctcagttacca

SEQ ID NO: 884 - DNA, 18 bp, Artificial Sequence
  Description of Artificial Sequence: Synthetic primer: nbla23231-1r
caaaaccgtcccgaagag

SEQ ID NO: 885 - DNA, 22 bp, Artificial Sequence
  Description of Artificial Sequence: Synthetic primer: nbla23284-1f(k)
gtgatgctgtcttgaattgtcc

SEQ ID NO: 886 - DNA, 20 bp, Artificial Sequence
  Description of Artificial Sequence: Synthetic primer: nbla23284-1r
cttatggacccgccttttct

SEQ ID NO: 887 - DNA, 20 bp, Artificial Sequence
  Description of Artificial Sequence: Synthetic primer: nbla23329-1d-1f(k)
gcatggacagttgtttggag

SEQ ID NO: 888 - DNA, 19 bp, Artificial Sequence
  Description of Artificial Sequence: Synthetic primer: nbla23329-1d-1r
ggaagaaccggaggacttg

SEQ ID NO: 889 - DNA, 19 bp, Artificial Sequence
  Description of Artificial Sequence: Synthetic primer: nbla23384-1f(k)
ttagccagcgcacctttac

SEQ ID NO: 890 - DNA, 20 bp, Artificial Sequence
  Description of Artificial Sequence: Synthetic primer: nbla23384-1r
tacccaccacatctccttcc

SEQ ID NO: 891 - DNA, 20 bp, Artificial Sequence
  Description of Artificial Sequence: Synthetic primer: nbla23556-1f(k)
ggaagtcctttccacctctc

SEQ ID NO: 892 - DNA, 20 bp, Artificial Sequence
  Description of Artificial Sequence: Synthetic primer: nbla23556-1r
agtcctatgcacgactccaa

SEQ ID NO: 893 - DNA, 19 bp, Artificial Sequence
  Description of Artificial Sequence: Synthetic primer: nbla23674r1-1f(k)
tgttcttcttggccttgct

SEQ ID NO: 894 - DNA, 20 bp, Artificial Sequence
  Description of Artificial Sequence: Synthetic primer: nbla23674r1-1r
ctgcatcctcatcctcctct

SEQ ID NO: 895 - DNA, 23 bp, Artificial Sequence
  Description of Artificial Sequence: Synthetic primer: nbla23879-2-1f(k)
cattctgtttgatcttcggtctc

SEQ ID NO: 896 - DNA, 21 bp, Artificial Sequence
  Description of Artificial Sequence: Synthetic primer: nbla23879-2-1r
agctgtagcagtggatgcttt

SEQ ID NO: 897 - DNA, 20 bp, Artificial Sequence
  Description of Artificial Sequence: Synthetic primer: nbla24098r1-1f(k)
tagggcttcatgtgggaaac

SEQ ID NO: 898 - DNA, 18 bp, Artificial Sequence
  Description of Artificial Sequence: Synthetic primer: nbla24098r1-1r
agccgcgaaactgagaac

SEQ ID NO: 899 - DNA, 20 bp, Artificial Sequence
  Description of Artificial Sequence: Synthetic primer: nbla24329-1f(k)
aggtggaggctgatgacttg

SEQ ID NO: 900 - DNA, 21 bp, Artificial Sequence
  Description of Artificial Sequence: Synthetic primer: nbla24329-1r
tctctgaatagtgccccgtag

SEQ ID NO: 901 - DNA, 20 bp, Artificial Sequence
  Description of Artificial Sequence: Synthetic primer: nbla24334-1f(k)
tgggtaaaggacgaggaaga

SEQ ID NO: 902 - DNA, 21 bp, Artificial Sequence
  Description of Artificial Sequence: Synthetic primer: nbla24334-1r
caggccatctatcaaccacac

SEQ ID NO: 903 - DNA, 18 bp, Artificial Sequence
  Description of Artificial Sequence: Synthetic primer: nbla24439-1-1f(k)
ggcggtgcagatccagtt

SEQ ID NO: 904 - DNA, 18 bp, Artificial Sequence
  Description of Artificial Sequence: Synthetic primer: nbla24439-1r
gtcacgttgccgtccttg

SEQ ID NO: 905 - DNA, 21 bp, Artificial Sequence
  Description of Artificial Sequence: Synthetic primer: nbla24507-1f(k)
aacccgcatggaattatctgt

SEQ ID NO: 906 - DNA, 19 bp, Artificial Sequence
  Description of Artificial Sequence: Synthetic primer: nbla24507-1r
ctttggtgaagggcatggt

SEQ ID NO: 907 - DNA, 20 bp, Artificial Sequence
  Description of Artificial Sequence: Synthetic primer: nbla24836-1f(k)
cacgttgacaggtttgcttg

SEQ ID NO: 908 - DNA, 21 bp, Artificial Sequence
  Description of Artificial Sequence: Synthetic primer: nbla24836-1r
ccttgctctgttgacattcct

SEQ ID NO: 909 - DNA, 20 bp, Artificial Sequence
  Description of Artificial Sequence: Synthetic primer: nbla24958-1f(k)
tggagcagttggctaaagag

SEQ ID NO: 910 - DNA, 22 bp, Artificial Sequence
  Description of Artificial Sequence: Synthetic primer: nbla24958-1r
agtgatggtactggatgtctgg

SEQ ID NO: 911 - DNA, 20 bp, Artificial Sequence
  Description of Artificial Sequence: Synthetic primer: nbla24989-1f(k)
tggaaatctatcgccctcac

SEQ ID NO: 912 - DNA, 21 bp, Artificial Sequence
  Description of Artificial Sequence: Synthetic primer: nbla24989-1r
acagaactcaaacaggccatc

SEQ ID NO: 913 - DNA, 20 bp, Artificial Sequence
  Description of Artificial Sequence: Synthetic primer: nbla20393d-1f(k)
agtgcagaaaaccgacgaag

SEQ ID NO: 914 - DNA, 20 bp, Artificial Sequence
  Description of Artificial Sequence: Synthetic primer: nbla20393d-1r
ggtcaggccattgaagagag

SEQ ID NO: 915 - DNA, 20 bp, Artificial Sequence
  Description of Artificial Sequence: Synthetic primer: nbla20423d-1f(k)
tggtctatcaccccagcttc

SEQ ID NO: 916 - DNA, 22 bp, Artificial Sequence
  Description of Artificial Sequence: Synthetic primer: nbla20423d-1r
gttcttcaccttctccaacacc

SEQ ID NO: 917 - DNA, 20 bp, Artificial Sequence
  Description of Artificial Sequence: Synthetic primer: nbla20510-1f(k)
gttcactggtgctcattcca

SEQ ID NO: 918 - DNA, 22 bp, Artificial Sequence
  Description of Artificial Sequence: Synthetic primer: nbla20510-1r
tgatctcctccctcttatccac

SEQ ID NO: 919 - DNA, 19 bp, Artificial Sequence
  Description of Artificial Sequence: Synthetic primer: nbla20833d-1f(k)
gctaatcaaagcggcaaca

SEQ ID NO: 920 - DNA, 22 bp, Artificial Sequence
  Description of Artificial Sequence: Synthetic primer: nbla20833d-1r
tccatcagtctcttcccatacc

SEQ ID NO: 921 - DNA, 20 bp, Artificial Sequence
  Description of Artificial Sequence: Synthetic primer: nbla20931-1f(k)
tagcagggaagccaaagatg

SEQ ID NO: 922 - DNA, 23 bp, Artificial Sequence
  Description of Artificial Sequence: Synthetic primer: nbla20931-1r
cagtacacaggctccagaagaag

SEQ ID NO: 923 - DNA, 20 bp, Artificial Sequence
  Description of Artificial Sequence: Synthetic primer: nbla20943-1f(k)
tctaggctgcttggttcgtg

SEQ ID NO: 924 - DNA, 19 bp, Artificial Sequence
  Description of Artificial Sequence: Synthetic primer: nbla20943-1r
gatcttcctgtggggcttg

SEQ ID NO: 925 - DNA, 19 bp, Artificial Sequence
  Description of Artificial Sequence: Synthetic primer: nbla21258r1-1f(k)
ttaaggcgggtctctgttc

SEQ ID NO: 926 - DNA, 21 bp, Artificial Sequence
  Description of Artificial Sequence: Synthetic primer: nbla21258-1r
tggaaacctcaaggaaaactc

SEQ ID NO: 927 - DNA, 19 bp, Artificial Sequence
  Description of Artificial Sequence: Synthetic primer: nbla21268-1f(k)
cctagagggcagatgcaga

SEQ ID NO: 928 - DNA, 18 bp, Artificial Sequence
  Description of Artificial Sequence: Synthetic primer: nbla21268-1r
gcctgagagggaaaccac

SEQ ID NO: 929 - DNA, 20 bp, Artificial Sequence
  Description of Artificial Sequence: Synthetic primer: nbla21273-1f(k)
agagccttcctcacccaaac

SEQ ID NO: 930 - DNA, 20 bp, Artificial Sequence
  Description of Artificial Sequence: Synthetic primer: nbla21273-1r
agctccttcacctcctcaca

SEQ ID NO: 931 - DNA, 20 bp, Artificial Sequence
  Description of Artificial Sequence: Synthetic primer: nbla21412-1f(k)
ttgaacaggagaagcaagca

SEQ ID NO: 932 - DNA, 19 bp, Artificial Sequence
  Description of Artificial Sequence: Synthetic primer: nbla21412-1r
cggccttcgttgtcagtag

SEQ ID NO: 933 - DNA, 20 bp, Artificial Sequence
  Description of Artificial Sequence: Synthetic primer: nbla21578-1f(k)
ctcctcctgttgctgatcct

SEQ ID NO: 934 - DNA, 20 bp, Artificial Sequence
  Description of Artificial Sequence: Synthetic primer: nbla21578-1r
tggtgtcagtgctgttcctc

SEQ ID NO: 935 - DNA, 19 bp, Artificial Sequence
  Description of Artificial Sequence: Synthetic primer: nbla21614-1f(k)
tggtatgagccaatgcaga

SEQ ID NO: 936 - DNA, 22 bp, Artificial Sequence
  Description of Artificial Sequence: Synthetic primer: nbla21614-1r
ctgtaaaccatgaagatgcaga

SEQ ID NO: 937 - DNA, 21 bp, Artificial Sequence
  Description of Artificial Sequence: Synthetic primer: nbla21624-1f(k)
tgggaacatacgatgatggag

SEQ ID NO: 938 - DNA, 20 bp, Artificial Sequence
  Description of Artificial Sequence: Synthetic primer: nbla21624-1r
agtcttgcttctgggggatg

SEQ ID NO: 939 - DNA, 19 bp, Artificial Sequence
  Description of Artificial Sequence: Synthetic primer: nbla21655-1f(k)
tgtcattgtgctggctgtg

SEQ ID NO: 940 - DNA, 20 bp, Artificial Sequence
  Description of Artificial Sequence: Synthetic primer: nbla21655-1r
acctccaccttccctgttgt

SEQ ID NO: 941 - DNA, 20 bp, Artificial Sequence
  Description of Artificial Sequence: Synthetic primer: nbla21670-1f(k)
gtctttgaacgccattaccc

SEQ ID NO: 942 - DNA, 21 bp, Artificial Sequence
  Description of Artificial Sequence: Synthetic primer: nbla21670-1r
ttgttcccctatctacccaca

SEQ ID NO: 943 - DNA, 23 bp, Artificial Sequence
  Description of Artificial Sequence: Synthetic primer: nbla21787-1f(k)
agccctctcactatatgctatcc

SEQ ID NO: 944 - DNA, 23 bp, Artificial Sequence
  Description of Artificial Sequence: Synthetic primer: nbla21787-1r
gggtgtatatttcctttgtgtcc

SEQ ID NO: 945 - DNA, 22 bp, Artificial Sequence
  Description of Artificial Sequence: Synthetic primer: nbla21954-1f(k)
ccagcttcctacaacaccatct

SEQ ID NO: 946 - DNA, 20 bp, Artificial Sequence
  Description of Artificial Sequence: Synthetic primer: nbla21954-1r
tacaagccaacgctttctcc

SEQ ID NO: 947 - DNA, 21 bp, Artificial Sequence
  Description of Artificial Sequence: Synthetic primer: nbla21979-1f(k)
catgtagtgggttcggagatg

SEQ ID NO: 948 - DNA, 20 bp, Artificial Sequence
  Description of Artificial Sequence: Synthetic primer: nbla21979-1r
cgtagccatcagtgcaagag

SEQ ID NO: 949 - DNA, 19 bp, Artificial Sequence
  Description of Artificial Sequence: Synthetic primer: nbla22043-1f(k)
ggcccagaacaactgctac

SEQ ID NO: 950 - DNA, 18 bp, Artificial Sequence
  Description of Artificial Sequence: Synthetic primer: nbla22043-1r
aggccaccctccttcttc

SEQ ID NO: 951 - DNA, 18 bp, Artificial Sequence
  Description of Artificial Sequence: Synthetic primer: nbla22137r1-1f(k)
aggcattaagggcacacc

SEQ ID NO: 952 - DNA, 21 bp, Artificial Sequence
  Description of Artificial Sequence: Synthetic primer: nbla22137r1-1r
ctgcaagtaaataggcccaga

SEQ ID NO: 953 - DNA, 20 bp, Artificial Sequence
  Description of Artificial Sequence: Synthetic primer: nbla22192-1f(k)
cgttatggtggtcatgttgg

SEQ ID NO: 954 - DNA, 20 bp, Artificial Sequence
  Description of Artificial Sequence: Synthetic primer: nbla22192-1r
tgccttcttcctgctgttct

SEQ ID NO: 955 - DNA, 20 bp, Artificial Sequence
  Description of Artificial Sequence: Synthetic primer: nbla22325d-1f(k)
ccattgtactgcccgtctct

SEQ ID NO: 956 - DNA, 19 bp, Artificial Sequence
  Description of Artificial Sequence: Synthetic primer: nbla22325d-1r
gtccccactttccatcacc

SEQ ID NO: 957 - DNA, 20 bp, Artificial Sequence
  Description of Artificial Sequence: Synthetic primer: nbla22327-1f(k)
tgtttgcttcttgccatcac

SEQ ID NO: 958 - DNA, 22 bp, Artificial Sequence
  Description of Artificial Sequence: Synthetic primer: nbla22327-1r
tgcctctttatcacctaccaca

SEQ ID NO: 959 - DNA, 21 bp, Artificial Sequence
  Description of Artificial Sequence: Synthetic primer: nbla22337-1f(k)
ggctgttcttaccatctcctt

SEQ ID NO: 960 - DNA, 23 bp, Artificial Sequence
  Description of Artificial Sequence: Synthetic primer: nbla22337-1r
agctcctgctaaattctaacctc

SEQ ID NO: 961 - DNA, 20 bp, Artificial Sequence
  Description of Artificial Sequence: Synthetic primer: nbla22482-1f(k)
gctgcgtctcatacaaacca

SEQ ID NO: 962 - DNA, 22 bp, Artificial Sequence
  Description of Artificial Sequence: Synthetic primer: nbla22482-1r
catccacagcaactttcacatc

SEQ ID NO: 963 - DNA, 20 bp, Artificial Sequence
  Description of Artificial Sequence: Synthetic primer: nbla22763-1f(k)
cagcacagcaactcaggaac

SEQ ID NO: 964 - DNA, 18 bp, Artificial Sequence
  Description of Artificial Sequence: Synthetic primer: nbla22763-1r
tggcaaacttgaggcaga

SEQ ID NO: 965 - DNA, 19 bp, Artificial Sequence
  Description of Artificial Sequence: Synthetic primer: nbla22788-1f(k)
ctggatcaggtttcccaca

SEQ ID NO: 966 - DNA, 20 bp, Artificial Sequence
  Description of Artificial Sequence: Synthetic primer: nbla22788-1r
aggcagctcaaatccttcac

SEQ ID NO: 967 - DNA, 19 bp, Artificial Sequence
  Description of Artificial Sequence: Synthetic primer: nbla22839-1f(k)
tgtcatcacgcttcccttc

SEQ ID NO: 968 - DNA, 20 bp, Artificial Sequence
  Description of Artificial Sequence: Synthetic primer: nbla22839-1r
gacgccaacatagaccacct

SEQ ID NO: 969 - DNA, 20 bp, Artificial Sequence
  Description of Artificial Sequence: Synthetic primer: nbla22851-1f(k)
atgcctctgcctcatctcac

SEQ ID NO: 970 - DNA, 20 bp, Artificial Sequence
  Description of Artificial Sequence: Synthetic primer: nbla22851-1r
gctctgcctgctgactctct

SEQ ID NO: 971 - DNA, 22 bp, Artificial Sequence
  Description of Artificial Sequence: Synthetic primer: nbla22935-1f(k)
tgactaacgctcacataactgg

SEQ ID NO: 972 - DNA, 22 bp, Artificial Sequence
  Description of Artificial Sequence: Synthetic primer: nbla22935-1r
tgcttaccttcttgcttaatgg

SEQ ID NO: 973 - DNA, 20 bp, Artificial Sequence
  Description of Artificial Sequence: Synthetic primer: nbla22937-1f(k)
gcagtttgagggtgttttgg

SEQ ID NO: 974 - DNA, 21 bp, Artificial Sequence
  Description of Artificial Sequence: Synthetic primer: nbla22937-1r
atttctactggggagggagga

SEQ ID NO: 975 - DNA, 23 bp, Artificial Sequence
  Description of Artificial Sequence: Synthetic primer: nbla23238-1f(k)
gccactccttctcagtcttcatc

SEQ ID NO: 976 - DNA, 20 bp, Artificial Sequence
  Description of Artificial Sequence: Synthetic primer: nbla23238-1r
gttccatcaactcccaagca

SEQ ID NO: 977 - DNA, 22 bp, Artificial Sequence
  Description of Artificial Sequence: Synthetic primer: nbla23327-1f(k)
gaagggctactctatggtgagg

SEQ ID NO: 978 - DNA, 20 bp, Artificial Sequence
  Description of Artificial Sequence: Synthetic primer: nbla23327-1r
aatggactggtggaacttgg

SEQ ID NO: 979 - DNA, 19 bp, Artificial Sequence
  Description of Artificial Sequence: Synthetic primer: nbla23360-1f(k)
gacgtgctcaaggaagtgg

SEQ ID NO: 980 - DNA, 21 bp, Artificial Sequence
  Description of Artificial Sequence: Synthetic primer: nbla23360-1r
tgatgaactcgacccagagag

SEQ ID NO: 981 - DNA, 20 bp, Artificial Sequence
  Description of Artificial Sequence: Synthetic primer: nbla23519-1f(k)
gaacaggatttcccctagca

SEQ ID NO: 982 - DNA, 20 bp, Artificial Sequence
  Description of Artificial Sequence: Synthetic primer: nbla23519-1r
ctctgaaagacccccacatc

SEQ ID NO: 983 - DNA, 20 bp, Artificial Sequence
  Description of Artificial Sequence: Synthetic primer: nbla23553-1f(k)
cagagggagggtgttacgag

SEQ ID NO: 984 - DNA, 18 bp, Artificial Sequence
  Description of Artificial Sequence: Synthetic primer: nbla23553-1r
ggcacgatattgggatgg

SEQ ID NO: 985 - DNA, 20 bp, Artificial Sequence
  Description of Artificial Sequence: Synthetic primer: nbla23554-1f(k)
gccaaagtgtatgggatgct

SEQ ID NO: 986 - DNA, 21 bp, Artificial Sequence
  Description of Artificial Sequence: Synthetic primer: nbla23554-1r
ctggacctgtgtgaactgatg

SEQ ID NO: 987 - DNA, 20 bp, Artificial Sequence
  Description of Artificial Sequence: Synthetic primer: nbla23683-1f(k)
tctgtgaccagggttttgtg

SEQ ID NO: 988 - DNA, 20 bp, Artificial Sequence
  Description of Artificial Sequence: Synthetic primer: nbla23683-1r
cacacgagaagtggatggtg

SEQ ID NO: 989 - DNA, 19 bp, Artificial Sequence
  Description of Artificial Sequence: Synthetic primer: nbla23812-1f(k)
ctgcacacagccacgattt

SEQ ID NO: 990 - DNA, 22 bp, Artificial Sequence
  Description of Artificial Sequence: Synthetic primer: nbla23812-1r
tggcaggttaaatgtcttctcc

SEQ ID NO: 991 - DNA, 21 bp, Artificial Sequence
  Description of Artificial Sequence: Synthetic primer: nbla23823-1f(k)
gccagagtcccagctttctac

SEQ ID NO: 992 - DNA, 20 bp, Artificial Sequence
  Description of Artificial Sequence: Synthetic primer: nbla23823-1r
agttgtcccttcctcgcttc

SEQ ID NO: 993 - DNA, 19 bp, Artificial Sequence
  Description of Artificial Sequence: Synthetic primer: nbla23849-1f(k)
agcaacacgcaaacgagag

SEQ ID NO: 994 - DNA, 21 bp, Artificial Sequence
  Description of Artificial Sequence: Synthetic primer: nbla23849-1r
gcatctcctgccttgattaga

SEQ ID NO: 995 - DNA, 20 bp, Artificial Sequence
  Description of Artificial Sequence: Synthetic primer: nbla23882-1f(k)
tgctactgggagctgatgtg

SEQ ID NO: 996 - DNA, 20 bp, Artificial Sequence
  Description of Artificial Sequence: Synthetic primer: nbla23882-1r
cggatggcaaacttctctgt

SEQ ID NO: 997 - DNA, 21 bp, Artificial Sequence
  Description of Artificial Sequence: Synthetic primer: nbla23910r1-1f(k)
catggaaacaacgaaggaaca

SEQ ID NO: 998 - DNA, 19 bp, Artificial Sequence
  Description of Artificial Sequence: Synthetic primer: nbla23910r1-1r
gacttggggttggaacagg

SEQ ID NO: 999 - DNA, 18 bp, Artificial Sequence
  Description of Artificial Sequence: Synthetic primer: nbla24064-1f(k)
cggaggagaaacggaggt

SEQ ID NO: 1000 - DNA, 19 bp, Artificial Sequence
  Description of Artificial Sequence: Synthetic primer: nbla24064-1r
gctattgacccgtgggaag

SEQ ID NO: 1001 - DNA, 20 bp, Artificial Sequence
  Description of Artificial Sequence: Synthetic primer: nbla24405-1f(k)
agccagtacacgcaggaaac

SEQ ID NO: 1002 - DNA, 21 bp, Artificial Sequence
  Description of Artificial Sequence: Synthetic primer: nbla24405-1r
catcaaaccacctccacaaga

SEQ ID NO: 1003 - DNA, 20 bp, Artificial Sequence
  Description of Artificial Sequence: Synthetic primer: nbla24897-1f(k)
aggagtttgctgctgctctc

SEQ ID NO: 1004 - DNA, 20 bp, Artificial Sequence
  Description of Artificial Sequence: Synthetic primer: nbla24897-1r
tcagtccctgcttccctatc

SEQ ID NO: 1005 - DNA, 20 bp, Artificial Sequence
  Description of Artificial Sequence: Synthetic primer: nbla24913-1f(k)
atcaggtggtggaagatgga

SEQ ID NO: 1006 - DNA, 20 bp, Artificial Sequence
  Description of Artificial Sequence: Synthetic primer: nbla24913-1r
cggattagctgttcgaggtg

SEQ ID NO: 1007 - DNA, 19 bp, Artificial Sequence
  Description of Artificial Sequence: Synthetic primer: nbla20624d-1f(k)
ttctggtgcgagttttgga

SEQ ID NO: 1008 - DNA, 20 bp, Artificial Sequence
  Description of Artificial Sequence: Synthetic primer: nbla20624d-1r
tctgaatgggcaagaaggag

SEQ ID NO: 1009 - DNA, 21 bp, Artificial Sequence
  Description of Artificial Sequence: Synthetic primer: nbla22029-1f(k)
cagggacaggaaagataggag

SEQ ID NO: 1010 - DNA, 20 bp, Artificial Sequence
  Description of Artificial Sequence: Synthetic primer: nbla22029-1r
gctgaactctggatgtctgg

SEQ ID NO: 1011 - DNA, 21 bp, Artificial Sequence
  Description of Artificial Sequence: Synthetic primer: nbla22424r1d-1f(k)
tgcaccagctctttcttctgt

SEQ ID NO: 1012 - DNA, 21 bp, Artificial Sequence
  Description of Artificial Sequence: Synthetic primer: nbla22424r1s-1r
catgatcctctcctgcatctc

SEQ ID NO: 1013 - DNA, 24 bp, Artificial Sequence
  Description of Artificial Sequence: Synthetic primer: nbla22594-1f(k)
cacgatattcagaccttgactttg

SEQ ID NO: 1014 - DNA, 20 bp, Artificial Sequence
  Description of Artificial Sequence: Synthetic primer: nbla22594-1r
agcatcctttgcctctgtgt

SEQ ID NO: 1015 - DNA, 19 bp, Artificial Sequence
  Description of Artificial Sequence: Synthetic primer: nbla22622-1f(k)
gcaagggggtcttcttcct

SEQ ID NO: 1016 - DNA, 19 bp, Artificial Sequence
  Description of Artificial Sequence: Synthetic primer: nbla22622-1r
ggctggcaagttcattcct

SEQ ID NO: 1017 - DNA, 20 bp, Artificial Sequence
  Description of Artificial Sequence: Synthetic primer: nbla20117d-1f(k)
tggaccttgtggttgagttg

SEQ ID NO: 1018 - DNA, 20 bp, Artificial Sequence
  Description of Artificial Sequence: Synthetic primer: nbla20117-1r
ctcttttggattgctgcttg

SEQ ID NO: 1019 - DNA, 18 bp, Artificial Sequence
  Description of Artificial Sequence: Synthetic primer: nbla20238-1f(k)
cgtggggatgtagcagga

SEQ ID NO: 1020 - DNA, 20 bp, Artificial Sequence
  Description of Artificial Sequence: Synthetic primer: nbla20238-1r
ctggaaagatggggaaggag

SEQ ID NO: 1021 - DNA, 21 bp, Artificial Sequence
  Description of Artificial Sequence: Synthetic primer: nbla20904-1f(k)
acgtggatttatggtctgtgg

SEQ ID NO: 1022 - DNA, 20 bp, Artificial Sequence
  Description of Artificial Sequence: Synthetic primer: nbla20904-1r
tgggaaaaggacatcaggaa

SEQ ID NO: 1023 - DNA, 20 bp, Artificial Sequence
  Description of Artificial Sequence: Synthetic primer: nbla23293-1f(k)
tgatgctgggcaactacaga

SEQ ID NO: 1024 - DNA, 20 bp, Artificial Sequence
  Description of Artificial Sequence: Synthetic primer: nbla23293-1r
tccaaaactagccaggagga

SEQ ID NO: 1025 - DNA, 22 bp, Artificial Sequence
  Description of Artificial Sequence: Synthetic primer: nbla23297d-1f(k)
acaagaaagcagtggagaggag

SEQ ID NO: 1026 - DNA, 21 bp, Artificial Sequence
  Description of Artificial Sequence: Synthetic primer: nbla23297d-1r
gttttgctgttggtcacttgg

SEQ ID NO: 1027 - DNA, 21 bp, Artificial Sequence
  Description of Artificial Sequence: Synthetic primer: nbla23311-1f(k)
tctccgttggtctcactgtct

SEQ ID NO: 1028 - DNA, 21 bp, Artificial Sequence
  Description of Artificial Sequence: Synthetic primer: nbla23311-1r
ggccacaatttccatatcctc

SEQ ID NO: 1029 - DNA, 22 bp, Artificial Sequence
  Description of Artificial Sequence: Synthetic primer: nbla23589-1f(k)
gaagcatgagcccgtatttatc

SEQ ID NO: 1030 - DNA, 22 bp, Artificial Sequence
  Description of Artificial Sequence: Synthetic primer: nbla23589-1r
tccacaacttcataatcccaca

SEQ ID NO: 1031 - DNA, 19 bp, Artificial Sequence
  Description of Artificial Sequence: Synthetic primer: nbla23629r1-1f(k)
gtggtcgcacctccattct

SEQ ID NO: 1032 - DNA, 19 bp, Artificial Sequence
  Description of Artificial Sequence: Synthetic primer: nbla23629r1-1r
acatgcggtggatttttgg

SEQ ID NO: 1033 - DNA, 20 bp, Artificial Sequence
  Description of Artificial Sequence: Synthetic primer: nbla23862d-1df(k)
gctcctgtgatctggatgga

SEQ ID NO: 1034 - DNA, 20 bp, Artificial Sequence
  Description of Artificial Sequence: Synthetic primer: nbla23862d-1dr
ccaagtgggacaaggtgaag

SEQ ID NO: 1035 - DNA, 20 bp, Artificial Sequence
  Description of Artificial Sequence: Synthetic primer: nbla24133r1-1f(k)
ccataagccaccccacttac

SEQ ID NO: 1036 - DNA, 19 bp, Artificial Sequence
  Description of Artificial Sequence: Synthetic primer: nbla24133r1-1r
gagccttgggtcatttgct

SEQ ID NO: 1037 - DNA, 18 bp, Artificial Sequence
  Description of Artificial Sequence: Synthetic primer: nbla24761-1f(k)
atggagccacgaacaacc

SEQ ID NO: 1038 - DNA, 23 bp, Artificial Sequence
  Description of Artificial Sequence: Synthetic primer: nbla24761-1r
ggtctgggaagtgtagttgaaga

SEQ ID NO: 1039 - DNA, 19 bp, Artificial Sequence
  Description of Artificial Sequence: Synthetic primer: nbla20279-1f(k)
cctatggacaccccaatcc

SEQ ID NO: 1040 - DNA, 19 bp, Artificial Sequence
  Description of Artificial Sequence: Synthetic primer: nbla20279-1r
ggcctgctttagctccttc

SEQ ID NO: 1041 - DNA, 19 bp, Artificial Sequence
  Description of Artificial Sequence: Synthetic primer: nbla20687-1f(k)
ggcagacctccagaccaac

SEQ ID NO: 1042 - DNA, 20 bp, Artificial Sequence
  Description of Artificial Sequence: Synthetic primer: nbla20687-1r
tgccacttccactacccaga

SEQ ID NO: 1043 - DNA, 19 bp, Artificial Sequence
  Description of Artificial Sequence: Synthetic primer: nbla20924d-1f(k)
gcagcctcagctcatacca

SEQ ID NO: 1044 - DNA, 20 bp, Artificial Sequence
  Description of Artificial Sequence: Synthetic primer: nbla20924d-1r
tccaaatcttccaccaaacc

SEQ ID NO: 1045 - DNA, 18 bp, Artificial Sequence
  Description of Artificial Sequence: Synthetic primer: nbla21168-1f(k)
caactccgtcagctcgtt

SEQ ID NO: 1046 - DNA, 20 bp, Artificial Sequence
  Description of Artificial Sequence: Synthetic primer: nbla21168-1r
ccagagccttttcattcttg

SEQ ID NO: 1047 - DNA, 20 bp, Artificial Sequence
  Description of Artificial Sequence: Synthetic primer: nbla21303-1f(k)
gttggctaccagaggaaatg

SEQ ID NO: 1048 - DNA, 20 bp, Artificial Sequence
  Description of Artificial Sequence: Synthetic primer: nbla21303-1r
tccacttagaaacggaagga

SEQ ID NO: 1049 - DNA, 21 bp, Artificial Sequence
  Description of Artificial Sequence: Synthetic primer: nbla21483-1f(k)
cacagcagaaaggaaaatgga

SEQ ID NO: 1050 - DNA, 20 bp, Artificial Sequence
  Description of Artificial Sequence: Synthetic primer: nbla21483-1r
tgataagcagcactggatgg

SEQ ID NO: 1051 - DNA, 23 bp, Artificial Sequence
  Description of Artificial Sequence: Synthetic primer: nnbla21838-1f(k
ctagaatagggaggtggagaatg

SEQ ID NO: 1052 - DNA, 19 bp, Artificial Sequence
  Description of Artificial Sequence: Synthetic primer: nbla21838-1r
ctgcgggttggtaattgag

SEQ ID NO: 1053 - DNA, 20 bp, Artificial Sequence
  Description of Artificial Sequence: Synthetic primer: nbla21917-1f(k)
tgagttctggattgcctgtg

SEQ ID NO: 1054 - DNA, 20 bp, Artificial Sequence
  Description of Artificial Sequence: Synthetic primer: nbla21917-1r
cagggcatggattcttttct

SEQ ID NO: 1055 - DNA, 20 bp, Artificial Sequence
  Description of Artificial Sequence: Synthetic primer: nbla22099-1f(k)
ctggttcccacgcaagtaag

SEQ ID NO: 1056 - DNA, 20 bp, Artificial Sequence
  Description of Artificial Sequence: Synthetic primer: nbla22099-1r
ggttcatggctctggaatgt

SEQ ID NO: 1057 - DNA, 20 bp, Artificial Sequence
  Description of Artificial Sequence: Synthetic primer: nbla22438-1f(k)
agcaggcatggcaattttag

SEQ ID NO: 1058 - DNA, 21 bp, Artificial Sequence
  Description of Artificial Sequence: Synthetic primer: nbla22438-1r
ccagaggtgcagagaagtgtg

SEQ ID NO: 1059 - DNA, 21 bp, Artificial Sequence
  Description of Artificial Sequence: Synthetic primer: nbla23111d-1f(k)
attcaccctctttggagaaca

SEQ ID NO: 1060 - DNA, 20 bp, Artificial Sequence
  Description of Artificial Sequence: Synthetic primer: nbla23111d-1r
ctaaaaggcgacagcacaag

SEQ ID NO: 1061 - DNA, 20 bp, Artificial Sequence
  Description of Artificial Sequence: Synthetic primer: nbla23208-1f(k)
tggtctccttcctgtgttcc

SEQ ID NO: 1062 - DNA, 19 bp, Artificial Sequence
  Description of Artificial Sequence: Synthetic primer: nbla23208-1r
gttgcctgcattctccaca

SEQ ID NO: 1063 - DNA, 20 bp, Artificial Sequence
  Description of Artificial Sequence: Synthetic primer: nbla24118-1f(k)
acaagtccacaccacagcac

SEQ ID NO: 1064 - DNA, 20 bp, Artificial Sequence
  Description of Artificial Sequence: Synthetic primer: nbla24118-1r
gagaaaccagaggccagaga

SEQ ID NO: 1065 - DNA, 20 bp, Artificial Sequence
  Description of Artificial Sequence: Synthetic primer: nbla24279-1f(k)
tggtcgggtcacaaatcttc

SEQ ID NO: 1066 - DNA, 19 bp, Artificial Sequence
  Description of Artificial Sequence: Synthetic primer: nbla24279-1r
aaccacactcctgcctcca

SEQ ID NO: 1067 - DNA, 23 bp, Artificial Sequence
  Description of Artificial Sequence: Synthetic primer: nbla24771d-1f(k)
caagtttgcctccttcatagaca

SEQ ID NO: 1068 - DNA, 24 bp, Artificial Sequence
  Description of Artificial Sequence: Synthetic primer: nbla24771d-1r
tgtacgcttattgatctcatcctc

SEQ ID NO: 1069 - DNA, 20 bp, Artificial Sequence
  Description of Artificial Sequence: Synthetic primer: nbla24871-1f(k)
cagcagggaacaaaactcca

SEQ ID NO: 1070 - DNA, 21 bp, Artificial Sequence
  Description of Artificial Sequence: Synthetic primer: nbla24871-1r
tggctacatgaaacgcatacc

SEQ ID NO: 1071 - DNA, 19 bp, Artificial Sequence
  Description of Artificial Sequence: Synthetic primer: nbla24443r1-1f(k)
gctgccactgctatgctct

SEQ ID NO: 1072 - DNA, 19 bp, Artificial Sequence
  Description of Artificial Sequence: Synthetic primer: nbla24443r1-1r
catgctgttctgcttgtgg

SEQ ID NO: 1073 - DNA, 22 bp, Artificial Sequence
  Description of Artificial Sequence: Synthetic primer: nbla23300-1f
gagagcagcgattaaccaaaag

SEQ ID NO: 1074 - DNA, 18 bp, Artificial Sequence
  Description of Artificial Sequence: Synthetic primer: nbla23300-1r
acatcaacttccctccaa

SEQ ID NO: 1075 - DNA, 21 bp, Artificial Sequence
  Description of Artificial Sequence: Synthetic primer: nbla23664-1f
ctttcatttctcctgctgtcc

SEQ ID NO: 1076 - DNA, 22 bp, Artificial Sequence
  Description of Artificial Sequence: Synthetic primer: nbla23664-1r
gggactcacccattttctattt

SEQ ID NO: 1077 - DNA, 20 bp, Artificial Sequence
  Description of Artificial Sequence: Synthetic primer: GAPD forward
acctgacctgccgtctagaa

SEQ ID NO: 1078 - DNA, 20 bp, Artificial Sequence
  Description of Artificial Sequence: Synthetic primer: GAPD reverse
tccaccaccctgttgctgta

SEQ ID NO: 1079 - RNA, 27 nt, Artificial Sequence
  Description of Artificial Sequence: Synthetic oligo-RNA sequence
agcaucgagucggccuuggccuacugg

SEQ ID NO: 1080 - DNA, 42 bp, Artificial Sequence
  Description of Artificial Sequence: Synthetic primer: oligo-dT adapter
gcggctgaagacggcctatgtggccttttttttttttttttt

SEQ ID NO: 1081 - DNA, 21 bp, Artificial Sequence
  Description of Artificial Sequence: Synthetic primer: forward
agcatcgagtcggccttgttg

SEQ ID NO: 1082 - DNA, 20 bp, Artificial Sequence
  Description of Artificial Sequence: Synthetic primer: reverse
gcgctgaagacggcctatgt

The invention claimed is:

1. An isolated nucleic acid comprising the nucleic acid sequence set forth in SEQ ID NO:1 in the Sequence Listing.

2. An isolated nucleic acid comprising the full complement to the nucleic acid according to claim 1.

3. An isolated nucleic acid probe comprising:
an isolated nucleic acid selected from the group consisting of the nucleic acid sequence set forth in SEQ ID NO:1 in the Sequence Listing and the full complement of SEQ ID NO:1.

4. A primer containing
an isolated nucleic acid comprising one sequence selected from the group consisting of the nucleic acid sequence set forth in SEQ ID NO:175 and SEQ ID NO:176 in the Sequence Listing, the full complement of SEQ ID NO:175, and the full complement of SEQ ID NO:176.

5. A method for determining whether a subject with neuroblastoma has stage 4s neuroblastoma, the method comprising detecting the presence or absence of the nucleic acid set forth in SEQ ID NO:1 in the Sequence Listing from a clinical tissue sample of neuroblastoma, wherein the presence of SEQ ID NO:1 indicates that the subject has stage 4s neuroblastoma.

6. A nucleic acid microarray comprising a solid phase support and an isolated nucleic acid comprising the nucleic acid sequence set forth in SEQ ID NO:1 in the Sequence Listing immobilized on the solid phase support.

7. A nucleic acid microarray comprising a solid phase support and at least one isolated nucleic acid selected from the group consisting of a the nucleic acid sequence set forth in SEQ ID NO:175 and the nucleic acid sequence set forth in SEQ ID NO:176, wherein the at least one isolated nucleic acid is immobilized on the solid phase support.

8. A method for determining whether a subject with neuroblastoma has stage 4s neuroblastoma, the method comprising detecting the presence or absence of the nucleic acid set forth in SEQ ID NO:1 in the Sequence Listing from a clinical tissue sample of neuroblastoma, wherein the presence of SEQ ID NO:1 indicates that the subject has stage 4s neuroblastoma, and wherein the presence of the nucleic acid sequence set forth in SEQ ID NO:1 is detected by a diagnostic agent comprising the isolated nucleic acid probe according to claim 3.

9. A method for determining whether a subject with neuroblastoma has stage 4s neuroblastoma, the method comprising detecting the presence or absence of the nucleic acid set forth in SEQ ID NO:1 in the Sequence Listing from a clinical tissue sample of neuroblastoma, wherein the presence of SEQ ID NO:1 indicates that the subject has stage 4s neuroblastoma, and wherein the presence of the nucleic acid sequence set forth in SEQ ID NO:1 is detected by a diagnostic kit comprising one pair of the primers according to claim 4.

* * * * *